US008513488B2

(12) United States Patent
Emmanuel et al.

(10) Patent No.: US 8,513,488 B2
(45) Date of Patent: Aug. 20, 2013

(54) POLYNUCLEOTIDES, POLYPEPTIDES AND METHODS FOR INCREASING OIL CONTENT, GROWTH RATE AND BIOMASS OF PLANTS

(75) Inventors: Eyal Emmanuel, Rechovot (IL); Gil Ronen, Emek Hefer (IL); Noa Savir, Givat Brenner (IL)

(73) Assignee: Evogene Ltd., Rechovot (IL)

( * ) Notice: Subject to any disclaimer, the term of this patent is extended or adjusted under 35 U.S.C. 154(b) by 360 days.

(21) Appl. No.: 12/594,853

(22) PCT Filed: Apr. 9, 2008

(86) PCT No.: PCT/IL2008/000489

§ 371 (c)(1), (2), (4) Date: Feb. 25, 2010

(87) PCT Pub. No.: WO2008/122980

PCT Pub. Date: Oct. 16, 2008

(65) Prior Publication Data

US 2010/0154077 A1 Jun. 17, 2010

Related U.S. Application Data

(60) Provisional application No. 60/907,568, filed on Apr. 9, 2007.

(51) Int. Cl.

| | |
|---|---|
| ***A01H 1/00*** | (2006.01) |
| ***A01H 5/00*** | (2006.01) |
| ***A01H 5/10*** | (2006.01) |
| ***C12N 15/82*** | (2006.01) |

(52) U.S. Cl.

USPC ........... 800/278; 800/281; 800/298; 800/312; 800/314; 800/320.1; 800/320.3; 435/419

(58) Field of Classification Search

None

See application file for complete search history.

(56) References Cited

U.S. PATENT DOCUMENTS

| | | | |
|---|---|---|---|
| 3,791,932 | A | 2/1974 | Schuurs et al. |
| 3,839,153 | A | 10/1974 | Schuurs et al. |
| 3,850,578 | A | 11/1974 | McConnell |
| 3,850,752 | A | 11/1974 | Schuurs et al. |
| 3,853,987 | A | 12/1974 | Dreyer |
| 3,867,517 | A | 2/1975 | Ling |
| 3,879,262 | A | 4/1975 | Schuurs et al. |
| 3,901,654 | A | 8/1975 | Gross |
| 3,935,074 | A | 1/1976 | Rubenstein et al. |
| 3,984,533 | A | 10/1976 | Uzgiris |
| 3,996,345 | A | 12/1976 | Ullman et al. |
| 4,034,074 | A | 7/1977 | Miles |
| 4,098,876 | A | 7/1978 | Piasio et al. |
| 4,666,828 | A | 5/1987 | Gusella |
| 4,683,202 | A | 7/1987 | Mullis |
| 4,801,531 | A | 1/1989 | Frossard |
| 4,879,219 | A | 11/1989 | Wands et al. |
| 4,943,674 | A | 7/1990 | Houck et al. |
| 4,945,050 | A | 7/1990 | Sanford et al. |
| 5,011,771 | A | 4/1991 | Bellet et al. |
| 5,187,267 | A | 2/1993 | Comai et al. |
| 5,192,659 | A | 3/1993 | Simons |
| 5,268,463 | A | 12/1993 | Jefferson |
| 5,272,057 | A | 12/1993 | Smulson et al. |
| 5,281,521 | A | 1/1994 | Trojanowski et al. |
| 5,296,462 | A | 3/1994 | Thomashow |
| 5,316,931 | A | 5/1994 | Donson et al. |
| 5,356,816 | A | 10/1994 | Thomashow |
| 5,399,680 | A | 3/1995 | Zhu et al. |
| 5,464,765 | A | 11/1995 | Coffee et al. |
| 5,466,785 | A | 11/1995 | De Framond |
| 5,495,070 | A | 2/1996 | John |
| 5,504,200 | A | 4/1996 | Hall et al. |
| 5,521,708 | A | 5/1996 | Beretta |
| 5,569,597 | A | 10/1996 | Grimsley et al. |
| 5,597,718 | A | 1/1997 | John et al. |
| 5,604,121 | A | 2/1997 | Hilder et al. |
| 5,608,142 | A | 3/1997 | Barton et al. |
| 5,608,144 | A | 3/1997 | Baden et al. |
| 5,608,149 | A | 3/1997 | Barry et al. |

(Continued)

FOREIGN PATENT DOCUMENTS

| | | |
|---|---|---|
| AU | 2005229157 | 10/2005 |
| AU | 2005234725 | 12/2005 |

(Continued)

OTHER PUBLICATIONS

Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005.* BLAST results.*

International Preliminary Report on Patentability Dated Jan. 14, 2010 From the International Bureau of WIPO Re.: Application No. PCT/IL2008/000489.

International Search Report and the Written Opinion Dated Nov. 24, 2008 From the International Searching Authority Re.: Application No. PCT/IL08/00489.

Supplementary European Search Report and the European Search Opinion Dated Aug. 11, 2010 From the European Patent Office Re. Application No. 08738191.9.

Cheuk et al. "*Arabidopsis thaliana* At2g46960/F14M4.21 mRNA, Complete CDS", Database EMBL [Online], XP002593835, Retrieved From EBI Accession No. EMBL:AY091688, Database Accession No. AY091688, Apr. 14, 2002.

(Continued)

*Primary Examiner* — Eileen B O Hara

(57) ABSTRACT

Provided are method of increasing oil content, growth rate, biomass, yield and/or vigor of a plant. The methods are effected by upregulating in the plant an expression level of a polypeptide comprising an amino acid sequence at least 90% homologous to the amino acid sequence selected from the group consisting of SEQ ID NOs: 199, 166-198, 200-221, 229-307, 311-330, 351-353, 355-361, 363-364, 366-368, 218, 222-228, 308-310, 350, 354, 362, 365, 523-649, 786-920, 1047 and 1048. Also provided are polynucleotides, nucleic acid constructs, polypeptides and transgenic plants expressing same which can be used to increase oil content, growth rate, biomass, yield and/or vigor of a plant and produce oil.

11 Claims, 3 Drawing Sheets

(56) References Cited

U.S. PATENT DOCUMENTS

| | | | |
|---|---|---|---|
| 5,608,152 | A | 3/1997 | Kridl et al. |
| 5,620,882 | A | 4/1997 | John |
| 5,659,026 | A | 8/1997 | Baszczynski et al. |
| 5,693,507 | A | 12/1997 | Daniell et al. |
| 5,859,330 | A | 1/1999 | Bestwick et al. |
| 5,880,100 | A | 3/1999 | Ogiso et al. |
| 5,961,466 | A | 10/1999 | Anbar |
| 5,981,834 | A | 11/1999 | John et al. |
| 6,080,914 | A | 6/2000 | Conner |
| 6,084,153 | A | 7/2000 | Good et al. |
| 6,094,198 | A | 7/2000 | Shashua |
| 6,167,151 | A | 12/2000 | Albeck et al. |
| 6,201,541 | B1 | 3/2001 | Shalom et al. |
| 6,313,375 | B1 | 11/2001 | Jung et al. |
| 6,313,376 | B1 | 11/2001 | Jung et al. |
| 6,359,196 | B1 | 3/2002 | Lok et al. |
| 6,392,122 | B1 | 5/2002 | Clendennen et al. |
| 6,403,862 | B1 | 6/2002 | Jiao et al. |
| 6,442,419 | B1 | 8/2002 | Chu et al. |
| 6,472,588 | B1 | 10/2002 | Haigler et al. |
| 6,670,528 | B1 | 12/2003 | Shinozaki et al. |
| 6,701,081 | B1 | 3/2004 | Dwyer et al. |
| 6,720,477 | B2 | 4/2004 | Da Costa e Silva et al. |
| 6,765,607 | B2 | 7/2004 | Mizusawa et al. |
| 6,801,257 | B2 | 10/2004 | Segev et al. |
| 6,850,862 | B1 | 2/2005 | Chidichimo et al. |
| 6,965,690 | B2 | 11/2005 | Matsumoto |
| 7,072,504 | B2 | 7/2006 | Miyano et al. |
| 7,214,786 | B2 | 5/2007 | Kovalic et al. |
| 7,292,719 | B2 | 11/2007 | Arnon |
| 7,554,007 | B2 | 6/2009 | Ronen et al. |
| 7,812,218 | B2 | 10/2010 | Ronen et al. |
| 7,910,800 | B2 | 3/2011 | Karchi et al. |
| 8,049,069 | B2 | 11/2011 | Wu et al. |
| 8,168,857 | B2 | 5/2012 | Ayal et al. |
| 2001/0046316 | A1 | 11/2001 | Miyano et al. |
| 2002/0046419 | A1 | 4/2002 | Choo et al. |
| 2002/0049999 | A1 | 4/2002 | Allen et al. |
| 2002/0148007 | A1 | 10/2002 | Jiao et al. |
| 2002/0160378 | A1 | 10/2002 | Harper et al. |
| 2002/0170088 | A1 | 11/2002 | Wilkins |
| 2003/0005485 | A1 | 1/2003 | Ohlrogge et al. |
| 2003/0074697 | A1 | 4/2003 | Allen et al. |
| 2003/0084485 | A1 | 5/2003 | Zhu et al. |
| 2003/0162294 | A1 | 8/2003 | Verbruggen |
| 2003/0163839 | A1 | 8/2003 | Helentjaris et al. |
| 2003/0233670 | A1 | 12/2003 | Edgerton et al. |
| 2004/0006794 | A1 | 1/2004 | Wilkins |
| 2004/0019927 | A1 | 1/2004 | Sherman et al. |
| 2004/0031072 | A1 | 2/2004 | La Rosa et al. |
| 2004/0034888 | A1 | 2/2004 | Liu et al. |
| 2004/0123343 | A1 | 6/2004 | La Rosa et al. |
| 2004/0172684 | A1 | 9/2004 | Kovalic et al. |
| 2004/0181830 | A1 | 9/2004 | Kovalic et al. |
| 2004/0236225 | A1 | 11/2004 | Murphy et al. |
| 2005/0096515 | A1 | 5/2005 | Geng |
| 2005/0108791 | A1 | 5/2005 | Edgerton |
| 2006/0048240 | A1 | 3/2006 | Alexandrov et al. |
| 2006/0101543 | A1 | 5/2006 | Somerville et al. |
| 2006/0107345 | A1 | 5/2006 | Alexandrov et al. |
| 2006/0123505 | A1 | 6/2006 | Kikuchi et al. |
| 2006/0123516 | A1 | 6/2006 | Ronen et al. |
| 2006/0137043 | A1 | 6/2006 | Puzio et al. |
| 2006/0143729 | A1 | 6/2006 | Alexandrov et al. |
| 2006/0150283 | A1 * | 7/2006 | Alexandrov et al. ......... 800/288 |
| 2006/0168684 | A1 | 7/2006 | Renz et al. |
| 2006/0174373 | A1 | 8/2006 | Gipmans et al. |
| 2006/0179511 | A1 | 8/2006 | Chomet et al. |
| 2006/0183137 | A1 | 8/2006 | Harper et al. |
| 2006/0195943 | A1 | 8/2006 | Feldmann et al. |
| 2006/0206961 | A1 | 9/2006 | Cirpus et al. |
| 2006/0260002 | A1 | 11/2006 | Ronen et al. |
| 2006/0288451 | A1 | 12/2006 | Val et al. |
| 2007/0006345 | A1 | 1/2007 | Alexandrov et al. |
| 2007/0006346 | A1 | 1/2007 | Alexandrov et al. |
| 2007/0044171 | A1 | 2/2007 | Kovalik et al. |
| 2007/0044172 | A1 | 2/2007 | Schneeberger et al. |
| 2007/0061916 | A1 | 3/2007 | Kovalic et al. |
| 2007/0124833 | A1 | 5/2007 | Abad et al. |
| 2007/0169219 | A1 | 7/2007 | Nadzan et al. |
| 2007/0214517 | A1 * | 9/2007 | Alexandrov et al. ......... 800/278 |
| 2007/0261130 | A1 | 11/2007 | Lightner et al. |
| 2008/0072340 | A1 | 3/2008 | Troukhan et al. |
| 2008/0076179 | A1 | 3/2008 | Hartel et al. |
| 2008/0148432 | A1 | 6/2008 | Abad |
| 2008/0196120 | A1 | 8/2008 | Wu et al. |
| 2008/0301839 | A1 | 12/2008 | Ravanello |
| 2009/0089898 | A1 | 4/2009 | Karchi et al. |
| 2009/0093620 | A1 | 4/2009 | Kovalic et al. |
| 2009/0126042 | A1 | 5/2009 | Ronen et al. |
| 2009/0260109 | A1 | 10/2009 | Ronen et al. |
| 2009/0293154 | A1 | 11/2009 | Yelin et al. |
| 2010/0037352 | A1 | 2/2010 | Alexandrov et al. |
| 2010/0154077 | A1 | 6/2010 | Emmanuel et al. |
| 2010/0319088 | A1 | 12/2010 | Ronen et al. |
| 2011/0080674 | A1 | 4/2011 | Durand |
| 2012/0060234 | A1 | 3/2012 | Emmanuel et al. |
| 2012/0084885 | A1 | 4/2012 | Alexandrov et al. |
| 2012/0096587 | A1 | 4/2012 | Vinocur et al. |
| 2012/0180164 | A1 | 7/2012 | Ayal et al. |
| 2012/0222169 | A1 | 8/2012 | Ronen et al. |
| 2012/0297504 | A1 | 11/2012 | Granevitze et al. |
| 2013/0125258 | A1 | 5/2013 | Emmanuel et al. |

FOREIGN PATENT DOCUMENTS

| | | |
|---|---|---|
| DE | 10150918 | 5/2003 |
| EP | 0834566 | 4/1998 |
| EP | 0905242 | 3/1999 |
| EP | 1033405 | 9/2000 |
| EP | 1225231 | 7/2002 |
| EP | 1945021 | 7/2008 |
| GB | 2358752 | 8/2001 |
| JP | 2005-052114 | 3/2005 |
| JP | 2005-185101 | 7/2005 |
| RU | 2350653 | 3/2009 |
| WO | WO 93/06710 | 4/1993 |
| WO | WO 93/07278 | 4/1993 |
| WO | WO 94/17194 | 8/1994 |
| WO | WO 95/08914 | 4/1995 |
| WO | WO 96/26639 | 9/1996 |
| WO | WO 96/40924 | 12/1996 |
| WO | WO 01/17333 | 3/2001 |
| WO | WO 01/40250 | 6/2001 |
| WO | WO 02/16655 | 2/2002 |
| WO | WO 02/45485 | 6/2002 |
| WO | WO 02/079403 | 10/2002 |
| WO | WO 02/090557 | 11/2002 |
| WO | WO 03/020025 | 3/2003 |
| WO | WO 03/087313 | 10/2003 |
| WO | WO 03/098186 | 11/2003 |
| WO | WO 2004/035798 | 4/2004 |
| WO | WO 2004/053055 | 6/2004 |
| WO | WO 2004/058963 | 7/2004 |
| WO | WO 2004/081173 | 9/2004 |
| WO | WO 2004/092367 | 10/2004 |
| WO | WO 2004/104162 | 12/2004 |
| WO | WO 2004/111183 | 12/2004 |
| WO | WO 2005/095614 | 10/2005 |
| WO | WO 2005/108422 | 11/2005 |
| WO | WO 2005/121364 | 12/2005 |
| WO | WO 2006/003658 | 1/2006 |
| WO | WO 2006/138012 | 12/2006 |
| WO | WO 2007/020638 | 2/2007 |
| WO | WO 2007/049275 | 5/2007 |
| WO | WO 2007/110314 | 10/2007 |
| WO | WO 2008/069878 | 6/2008 |
| WO | WO 2008/075364 | 6/2008 |
| WO | WO 2008/122980 | 10/2008 |
| WO | WO 2009/009142 | 1/2009 |
| WO | WO 2009/013750 | 1/2009 |
| WO | WO 2009/083958 | 7/2009 |
| WO | WO 2009/083973 | 7/2009 |
| WO | WO 2009/083974 | 7/2009 |
| WO | WO 2009/118721 | 10/2009 |

| WO | WO 2009/141824 | 11/2009 |
|---|---|---|
| WO | WO 2009/144311 | 12/2009 |
| WO | WO 2010/020941 | 2/2010 |
| WO | WO 2010/049897 | 5/2010 |
| WO | WO 2010/076756 | 7/2010 |
| WO | WO 2010/100595 | 9/2010 |
| WO | WO 2010/143138 | 12/2010 |
| WO | WO 2011/015985 | 2/2011 |
| WO | WO 2011/080674 | 7/2011 |
| WO | WO 2011/135527 | 11/2011 |
| WO | WO 2012/028993 | 3/2012 |
| WO | WO 2012/085862 | 6/2012 |
| WO | WO 2012/150598 | 11/2012 |

OTHER PUBLICATIONS

Kim et al. "*Arabidopsis thaliana* At2g46960/F14M4.21 mRNA, Complete CDS", Database EMBL [Online], XP002593834, Retrieved From EBI Accession No. EMBL:AF367329, Database Accession No. AF367329, Apr. 12, 2001.
Communication Pursuant to Article 94(3) EPC Dated Feb. 13, 2009 From the European Patent Office Re.: Application No. 05750089.4.
European Search Report and the European Search Opinion Dated Aug. 9, 2010 From the European Patent Office Re.: Application No. 09163033.5.
Examiner's Report Dated Dec. 17, 2009 From the Australian Patent Office Re.: Application No. 2005252469.
International Preliminary Report on Patentability Dated Jan. 21, 2010 From the International Bureau of WIPO Re.: Application No. PCT/IL2007/001590.
international Preliminary Report on Patentability Dated Mar. 29, 2007 From the International Bureau of WIPO Re.: Application No. PCT/IL2005/000627.
International Preliminary Report on Patentability Dated Jan. 30, 2007 From the International Bureau of WIPO Re.: Application No. PCT/IL05/00627.
International Search Report Dated Jul. 2, 2009 From the International Searching Authority Re.: Application No. PCT/IL07/01590.
International Search Report Dated Jan. 3, 2007 From the International Searching Authority Re.: Application No. PCT/IL2005/000627.
Invitation to Pay Additional Fees Dated Sep. 8, 2006 From the International Searching Authority Re.: Application No. PCT/IL05/00627.
Notice of Allowance Dated Apr. 16, 2010 From the US Patent and Trademark Office Re.: U.S. Appl. No. 11/629,411.
Office Action Dated May 13, 2010 From the Israel Patent Office Re. Application No. 180022 and Its Translation Into English.
Office Action Dated Jan. 22, 2010 From the State Intellectual Property Office of the People's Republic of China Re.: Application No. 200580027481.4 and Its Translation Into English.
Official Action Dated May 1, 2009 From the US Patent and Trademark Office Re.: U.S. Appl. No. 11/629,411.
Official Action Dated Sep. 2, 2009 From the US Patent and Trademark Office Re.: U.S. Appl. No. 11/629,411.
Official Action Dated Jun. 8, 2010 From the US Patent and Trademark Office Re.: U.S. Appl. No. 11/629,411.
Partial European Search Report Dated Apr. 19, 2010 From the European Patent Office Re.: Application No. 09163033.5.
Response Dated Jan. 4, 2010 to Official Action of Sep. 2, 2009 From the US Patent and Trademark Office Re.: U.S. Appl. No. 11/629,411.
Response Dated May 17, 2010 to Office Action of Jan. 22, 2010 From the State Intellectual Property Office of the People's Republic of China Re.: Application No. 200580027481.4.
Supplementary European Search Report and the European Search Opinion Dated Jul. 1, 2010 From the European Patent Office Re. Application No. 07849616.3.
Supplementary European Search Report Dated Apr. 23, 2008 From the European Patent Office Re.: Application No. 05750089.4.
Translation of Notice of Payment of the Restoration Fee for Unity of Invention Dated Mar. 20, 2009 From the State Intellectual Property Office of the People's Republic of China Re.: Application No. 200580027481.4.
Written Opinion Dated Jul. 2, 2009 From the International Searching Authority Re.: Application No. PCT/IL07/01590.
Written Opinion Dated Jan. 3, 2007 From the International Searching Authority Re.: Application No. PCT/IL2005/000627.
Blewitt et al. "BNLGHi10083 Six-Day Cotton Fiber Gossypium Hirsutum cDNA 5' Similar to (AC004521) Unknown Protein [*Arabidopsis thaliana*], mRNA Sequence", XP002576188, Retrieved Fron EBI Accession No. EMBL:AI728187, Database Accession No. AI728187, Jun. 12, 1999. Sequence.
Blewitt et al. "BNLGHi8081 Six-Day Cotton Fiber Gossypium Hirsutum cDNA 5' Similar to (AC004521) Unknown Protein [*Arabidopsis thalian*], mRNA Sequence", XP002576189, Retrieved From EBI Accesion No. EMBL:AI730835, Database Accession No. AI730835, Jun. 12, 1999. Sequence.
Blewitt et al. "BNLGHi8396 Six-Day Cotton Fiber Gossypium Hirsutum cDNA 5' Similar to (AC004521) Unknown Protein [*Arabidopsis Thaliana*], mRNA Sequence", XP002576190, Retrieved From EBI Accession No. EMBL:AI27553, Database Accession No. AI27553, Jun. 12, 1999. Sequence.
Bowie et al. "Deciphering the Message in Protein Sequences: Tolerance to Amino Acid Substitutions", Science, 247(4948): 1306-1310, Mar. 16, 1990.
François et al. "Overexpression of the VvLTP1 Gene Interferes With Somatic Embryo Development in Grapevine", Functional Plant Biology, 35(5): 394-402, 2008.
Ji et al. "Gossypium Hirsutum Expansin mRNA, Complete CDs", XP002474936, Retrieved From EBI Accession No. EMBL:AY189969, Database Accession No. AY189969.
Ji et al. "Isolation and Analyses of Genes Preferentially Expressed During Early Cotton Fiber Development by Subtractive PCR and cDNA Array", Nucleic Acids Research, XP002474935, 31(10): 2534-2543, May 15, 2003.
Kirubakaran et al. "Characterization of a New Antifungal Lipid Transfer Protein From Wheat", Plant Physiology and Biochemistry, 46: 918-927, 2008.
McConnell et al. "Role of PHABULOSA and PHAVULOTA in Determining Radial Patterning in Shoots", Nature, 411(6338): 709-713, Jun. 7, 2001.
Merriam-Webster "Exogenous Definition", Merrian-Webster On-Line Dictionary, 2010.
NCBI "Protein Sequence (588 Letters)", NCBI BLAST Basic Local Alignment Search Tool, 3 P., Retrieved From the Internet on Nov. 24, 2009.
Orford et al. "Specific Expression of an Expansin Gene During Elongation of Cotton Fibres", Biochimica et Biophysica Acta, XP000866032, 1398(3): 342-346, Jul. 9, 1998. Abstract, p. 343, Fig.1.
Orzaez et al. "Agroinjection of Tomato Fruits. A Tool for Rapid Functional Analysis of Transgenes Directly in Fruit", Plant Physiology, 140: 3-11, 2006.
Udall et al. "A Global Assembly of Cotton ESTs", Genome Research, 16(3): 441-450, 2006.
Wallace et al. "Oligonucleotide Probes for the Screening of Recombinant DNA Libraries", Methods in Enzymology, XP002957829, 152: 432-442, Jan. 1, 1987.
Wing et al. "An Integrated Analysis of the Genetics, Devlopment, and Evolution of Cotton Fiber", NBCI GenBank Accession No. BE052336, 2000.
Wing et al. "GA_Eb0023F09f Gossypium Arboreum 7-10 Dpa Fiber Library Gossypium Arboreum cDNA Clone GA_Eb0023F09f, mRNA Sequence", XP002576191, Retrieved From EBI Accession No. EMBL:BF275177, Database Accession No. BF275177, Nov. 20, 2000. Sequence.
Communication Pursuant to Article 94(3) EPC Dated Dec. 8, 2008 From the European Patent Office Re.: Application No. 04734072.4.
International Preliminary Report on Patentability Dated Dec. 8, 2005 From the International Bureau of WIPO Re.: Application No. PCT/IL2004/000431.
International Preliminary Report on Patentability Dated Jan. 22, 2009 From the International Bureau of WIPO Re.: Application No. PCT/IL2006/001223.
Invitation to Pay Additional Fees Dated Feb. 7, 2008 From the International Searching Authority Re.: Application No. PCT/IL06/001223.

Invitation to Pay Additional Fees Dated Dec. 18, 2008 From the international Searching Authority Re.: Application No. PCT/IL08/01024.
Communication Pursuant to Article 94(3) EPC Dated Sep. 9, 2009 From the European Patent Office Re.: Application No. 04734072.4.
Communication Pursuant to Article 94(3) EPC Dated May 12, 2010 From the European Patent Office Re.: Application No. 06766224.7.
Communication Pursuant to Article 94(3) EPC Dated Nov. 27, 2009 From the European Patent Office Re.: Application No. 06809784.9.
Communication Relating to the Results of the Partial International Search Dated Jul. 8, 2009 From the International Searching Authority Re.: Application No. PCT/IL2008/001657.
Examination Report Dated Nov. 13, 2007 From the Government of India, Patent Office Re.: Application No. 3482/CHENP/2005.
Examination Report Dated Feb. 17, 2010 From the Instituto Mexicano de la Propriedad Industrial Re. Application No. PA/a/2005/012565 and Its Summary in English.
International Preliminary Report on Patentability Dated Feb. 4, 2010 From the International Bureau of WIPO Re.: Application No. PCT/IL2008/001024.
International Preliminary Report on Patentability Dated Jul. 8, 2010 From the International Bureau of WIPO Re.: Application No. PCT/IL2008/001657.
International Preliminary Report on Patentability Dated Jan. 22, 2009 From the International Bureau of WIPO Re.: Application No. PCT/IL2006/000947.
International Search Report and the Written Opinion Dated Jul. 29, 2008 From the International Searching Authority Re.: Application No. PCT/IL06/001223.
International Search Report and the Written Opinion Dated Oct. 30, 2009 From the International Searching Authority Re.: Application No. PCT/IL2008/001657.
International Search Report Dated Mar. 4, 2009 From the International Searching Authority Re.: Application No. PCT/IL08/01024.
International Search Report Dated Nov. 4, 2005 From the International Searching Authority Re.: Application No. PCT/IL04/00431.
International Search Report Dated Aug. 27, 2008 From the International Searching Authority Re.: Application No. PCT/IL06/00947.
Invitation to Pay Additional Fees Dated Aug. 23, 2005 From the International Search Authority Re. Application No. PCT/IL2004/000431.
Office Action Dated Aug. 4, 2010 From the Israel Patent Office Re.: Application No. 172135 and Its Translation Into English.
Office Action Dated Jan. 9, 2009 From the State Intellectual Property Office of the People's Republic of China Re.: Application No. 200480020597.0.
Office Action Dated Jun. 17, 2010 From the Israel Patent Office Re. Application No. 190918 and Its Translation into English.
Office Action Dated Apr. 27, 2009 From the Israeli Patent Office Re.: Application No. 172135 and Its Translation Into English.
Office Action Dated Jan. 31, 2010 From the Israel Patent Office Re.: Application No. 172135 and Its Translation Into English.
Office Letter Dated Jul. 7, 2008 From the Government of India, Patent Office Re.: Application No. 3482/CHENP/2005.
Official Action Dated May 15, 2009 From the US Patent and Trademark Office Re.: U.S. Appl. No. 11/990,386.
Official Action Dated Aug. 18, 2010 From the US Patent and Trademark Office Re. U.S. Appl. No. 12/083,978.
Official Action Dated Oct. 18, 2007 From the US Patent and Trademark Office Re.: U.S. Appl. No. 11/284,236.
Official Action Dated Oct. 22, 2009 From the US Patent and Trademark Office Re.: U.S. Appl. No. 11/990,386.
Official Action Dated Jul. 28, 2008 From the US Patent and Trademark Office Re.: U.S. Appl. No. 11/284,236.
Response Dated Jan. 7, 2010 to Communication Pursuant to Article 94(3) EPC of Sep. 9, 2009 From the European Patent Office Re.: Application No. 04734072.4.
Response Dated Feb. 22, 2010 to Official Action of Oct. 22, 2009 From the US Patent and Trademark Office Re.: U.S. Appl. No. 11/990,386.
Response Dated Jun. 29, 2010 to Examination Report of Feb. 17, 2010 From the Instituto Mexicano de la Propriedad Industrial Re. Application No. PA/a/2005/012565.
Response Dated May 31, 2010 to Office Action of Jan. 31, 2010 From the Israel Patent Office Re.: Application No. 172135.
Supplementary European Search Report and the European Search Opinion Dated Feb. 1, 2010 From the European Patent Office Re.: Application No. 06766224.7.
Supplementary European Search Report and the European Search Opinion Dated Sep. 14, 2009 From the European Patent Office Re.: Application No. 06809784.9.
Supplementary European Search Report and the European Search Opinion Dated Jul. 29, 2010 From the European Patent Office Re. Application No. 08776651.5.
Supplementary European Search Report Dated Oct. 31, 2007 From the European Patent Office Re.: Application No. 04734072.4.
Supplementary Partial European Search Report Dated Aug. 30, 2007 From the European Patent Office Re.: Application No. 04734072.4.
Translation of the Office Action Dated Jan. 9, 2009 From the State Intellectual Property Office Re.: Application No. 2004800200597.0.
Written Opinion Dated Mar. 4, 2009 From the International Searching Authority Re.: Application No. PCT/Il08/01024.
Written Opinion Dated Nov. 4, 2005 From the International Searching Authority Re.: Application No. PCT/IL04/00431.
Written Opinion Dated Aug. 27, 2008 From the International Searching Authority Re.: Application No. PCT/IL06/00947.
Alcala et al. "Generation of ESTs From Tomato Fruit Tissue", Database GenBank on STIC, National Center for Biotechnology Information, Accession No. AW932839, 2001.
Apse et al. "Engineering Salt Tolerance in Plants", Current Opinion in Biotechnology, 13: 146-150, 2002.
Brandle et al. "Perspectives on the Production of Recombinant Proteins in Plants", AgBiotechNet, 3(ABN 070): 1-4, 2001. Abstract.
Fray et al. "Nucleotide Sequence and Expression of a Ripening and Water Stress-Related cDNA From tomato With Homology to the MIP Class of Membrane Channel Proteins", Plant Molecular Biology [Online], XP009117320, 24(3): 539-543, 1994. Figs.1, 2. & Database UniProt, REcName: Full=Probable Aquaporin PIP-Type pTOM75; AltName: Full=Ripening-Associated Membrane Protein; Short=RAMP, Oct. 1, 1994.
Gardiner et al. "*Zea mays* PCO131392 mRNA Sequence", Database EMBL/GenBank/DDBJ, EBI Database Accession No. AY107021, XP002542347, May 28, 2002. 96.5% Identity in 1118 nt Overlap of AY107021 (1118 nt) With SEQ ID No. 68 (1348 nt) of the Present Application, Abstract.
Grover et al. "Understanding Molecular Alphabets of the Plant Abiotic Stress Responses", Current Science, 80(2): 206-216, Jan. 25, 2001.
Guo et al. "Protein Tolerance to Random Amino Acid Change", Proceedings of the National Academy of Sciences USA, 101(25): 9205-9210, 2004.
Ilachez et al. "Modulating the Expression of Aquaporin Genes in Planta: A Key to Understand Their Physiological Functions?", Biochimica et Biophysica Acta, XP005655605, 1758(8): 1142-1156, Aug. 1, 2006. p. 1151, col. 1, § 2-p. 1153, col. 1, § 1, Table 1.
Hill et al. "Functional Analysis of Conserved Histidines in ADP-Glucose Pyrophosphorylase From *Escherichia coli*", Biochemical and Biophysical Research Communications, 244(2): 573-577, 1998.
In et al. "Panax Gingseng mRNA for Cytoplasmic Ribosomal Protein S13, Complete CDS", Database EMBL [Online], Retrieved From EBI Accession No. EMBL, Database Accession No. AB043974, 2000.
Keskin et al. "A New, Structurally Nonredundant, Diverse Data Set of Protein-Protein Interfaces and Its Implications", Protein Science, 13: 1043-1055, 2004.
Kim et al. "Molecular Cloning of Low-Temperature-Inducible Ribosomal Proteins From Soybean", Journal of Experimental Botany, 55(399): 1153-1155, 2004.
Kirkness et al. "Lycopersicon Esculentum Clone 133453R, mRNA Sequence", Database EMBL [Online], XP002529190, Retrieved From EBI Accession No. EMBL:BT014251, Database Accession No. BT014251, May 12, 2004.
Liu et al. "Root-Specific Expression of a Western White Pine PR10 Gene Is Mediated by Different Promoter Regions in Transgenic Tobacco", Plant Molecular Biology, 52: 103-120, 2003.

Maurel "Plant Aquaporins: Novel Functions and Regulation Properties", FEBS Letters, XP022078418, 581(12): 2227-2236, May 25, 2007. p. 2230, col. 2, Last §-p. 2231, col. 1, § 2, Fig.1.
Ngo et al. "Computational Complexity, Protein Structure Prediction, and the Levinthal Paradox", The Protein Folding Problem and Tertiary Structure Prediction, p. 433, 492-495, 1994.
Nuccio et al. "Metabolic Engineering of Plants for Osmotic Stress Resistance", Current Opinion in Plant Biology, XP002216348, 2(2): 128-134, Apr. 1, 1999.
Park et al. "Glycine Max Ribosomal Protein S13 (RPS13) mRNA, Complete Cds", Database EMBL [Online], Retreieved From EBI Accession No. EMBL, Database Accession No. AY453393, 2004.
Sáez-Vásquez et al. "Accumulation and Nuclear Targeting of BnC24, A *Brassica napus* Ribosomal Protein Corresponding to a mRNA Accumulating in Response to Cold Treatment", Plant Science, 156(1): 35-46, 2000.
Smart et al. "MIP Genes Are Down-Regulated Under Drought Stress in *Nicotiana glauca*", Plant and Cell Physiology, 42(7): 686-693, 2001. Referent to Database Entry AF290618 on p. 686, p. 692, 1-h col., § 2.
Smart et al. "*Nicotiana glauca* Putative Delta TIP (MIP2) mRNA, Complete Cds", Database EMBL [Online], Retrieved From EBI Accession No. EMBL: A1290618, Database Accession No. AF290618. 2002.
Tamura et al. "Osmotic Stress Tolerance of Transgenic Tobacco Expressing a Gene Encoding a Membrane-Located Receptor-Like Protein From Tobacco Plants", Plant Physiology, 131(2): 454-462, 2003.
Tanaka et al. "Enhanced Tolerance Against Salt-Stress and Freezing-Stress of *Escherichia coli* Cells Expressing Algal BBC1 Gene", Current Microbiology, 42(3): 173-177, 2001.
Thornton et al. "From Structure to Function: Approaches and Limitations", Nature Structural Biology. Structural Genomic Supplement, Nov. 2000, p. 991-994.
Van der Hoeven et al. "EST301294 Tomato Root During/After Fruit Set, Cornell University Lycopersicon Esculent um cDNA Clone cLEX1K11 Similar to *Vernicia Fordii* Aquaporin, mRNA Sequence", Database EMBL [Online], Retrieved From EBI Accession No. EMBL: AW218814, Database Accession No. AW218814. Abstract. 1999.
Van der Hoeven et al. "EST301295 Tomato Root During/After Fruit Set, Cornell University *Lycopersicon esculentum* cDNA Clone cLEX1K11 Similar to *Vernicia fordii* Aquaporin, mRNA Sequence", Database Embl [Online], Retrieved From EBI Accession No. EMBL: AW218815, Database Accession No. AW218815. Abstract, 1999.
Van der Hoeven et al. "EST428934 Tomato Nutrient Deficient Roots *Lycopersicon esculentum* cDNA Clone cLEW26B2 5' Sequence, mRNA Sequence", Database EMBL, Retrieved From EBI Accession No. EMBL, Database Accession No. BF098413, 2000.
Wells "Additivity of Mutational Effects in Proteins", Biochemistry, 29 (37): 8509-8517, 1990.
Wu et al. "SubName: Full=Major Intrinsic Protein", Database UniProt [Online], XP002529191, Retrieved From EBI Accession No. UNIPROT:AOFI89, Database Accession No. AOF189, Nov. 28, 2006.
Notice of Allowance Dated Aug. 11, 2010 From the Instituto Mexicano de la Propriedad Industrial Re. Application No. PA/a/2005/012565.
Blewitt et al. "BNLGHi8396 Six-Day Cotton Fiber *Gossypium hirsulum* cDNA 5' Similar to (AC004521) Unknown Protein [*Arabidopsis Thaliana*], mRNA Sequence", XP002576190, Retrieved From EBI Accession No. EMBL:AI27553, Database Accession No. AI27553, Jun. 12, 1999. Sequence.
Gardiner et al. "*Zea mays* PCO131392 mRNA Sequence", Database EMBL/GenBank/DDBJ, EBI Database Accession No. AY107021, XP002542347, May 28, 2002. 96,5% Identity in 1118 nt Overlap of AY107021 (1118 nt) With SEQ ID No. 68 (1348 nt) of the Present Application, Abstract.
Van der Hoeven et al. "EST301295 Tomato Root During/After Fruit Set, Cornell University Lycopersicon Esculentum cDNA Clone cLEX1K11 Similar to *Vernicia fordii* Aquaporin, mRNA Sequence", Database EMBL [Online], Retrieved From EBI Accession No. EMBL: AW218815, Database Accession No. AW218815. Abstract.
Wu et al. "SubName: Full=Major Intrinsic Protein", Database UniProt [Online], XP002529191, Retrieved From EBI Accession No. UNIPROT:AOFI89, Database Accession No. AOFI89, Nov. 28, 2006.
International Preliminary Report on Patentability Dated Dec. 2, 2010 From the International Bureau of WIPO Re. Application No. PCT/IL2009/000508.
Notice of Allowance Dated Oct. 18, 2010 From the US Patent and Trademark Office Re.: U.S. Appl. No. 11/990,386.
Office Action Dated Nov. 11, 2010 From the Israel Patent Office Re. Application No. 206118 and Its Translation Into English.
Official Action Dated Nov. 23, 2010 From the US Patent and Trademark Office Re. U.S. Appl. No. 12/083,978.
Response Dated Dec. 5, 2010 to Office Action of Aug. 4, 2010 From the Israel Patent Office Re.: Application No. 172135.
Response Dated Dec. 12, 2010 to Examiner's Report of Dec. 17, 2009 From the Australian Patent Office Re.: Application No. 2005252469.
Response Dated Dec. 14, 2010 to Examination Report of Sep. 22, 2010 From the Instituto Mexicano de la Propriedad Industrial Re. Application No. MX/a/2008/005280.
Response Dated Sep. 14, 2010 to Official Action of Aug. 18, 2010 From the US Patent and Trademark Office Re. U.S. Appl. No. 12/083,978.
Response Dated Oct. 24, 2010 to Office Action of Sep. 2, 2010 From the Rospatent, Federal State Institution, Federal Institute for Industrial Property of the Federal Service for Intellectual Property, Patents and Trademarks of the Russian Federation Re. Application No. 2008120395.
Summary of Office Action Dated Sep. 2, 2010 From the Rospatent, Federal State Institution, Federal Institute for Industrial Property of the Federal Service for Intellectual Property, Patents and Trademarks of the Russian Federation Re. Application No. 2008120395.
Translation of Office Action Dated Oct. 19, 2010 From the State Intellectual Property Office of the People's Republic of China Re. Application No. 200680038391.X.
Wang et al. "Control of Plant Trichome Development by a Cotton Fiber MYB Gene", The Plant Cell, 16: 2323-2334, Sep. 2004.
Wang et al. "Control of Plant Trichome Development by a Cotton Fiber MYB Gene", The Plant Cell, 16: 2323-2334, Sep. 2004. GenEmbl Database, Accession No. AY641990.
Communication Pursuant to Article 94(3) EPC Dated Jan. 12, 2011 From the European Patent Office Re. Application No. 08867385.0.
Communication Pursuant to Article 94(3) EPC Dated Dec. 21, 2010 From the European Patent Office Re. Application No. 08866783.7.
International Preliminary Report on Patentability Dated Oct. 7, 2010 From the International Bureau of WIPO Re. Application No. PCT/IL2008/001684.
International Preliminary Report on Patentability Dated Jul. 15, 2010 From the International Bureau of WIPO Re. Application No. PCT/IL2008/001683.
International Preliminary Report on Patentability Dated Jul. 15, 2010 From the International Bureau of WIPO Re. Application No. PCT/IL2008/001685.
International Search Report Dated Jun. 2, 2009 From the International Searching Authority Re.: Application No. PCT/IL2008/001681.
International Search Report. Dated Apr. 14, 2009 From the International Searching Authority Re.: Application No. PCT/IL2008/001684.
International Search Report Dated May 18, 2009 From International Searching Authority Re.: Application No. PCT/IL2008/001685.
Response Dated Aug. 11, 2011 to Examination Report of Aug. 1, 2011 From the Government of India, Patent Office Re.: Application No. 158/CHENP/2007.
Response Dated Jul. 12, 2011 to Communication Pursuant to Article 94(3) EPC of Jan. 12, 2011 From the European Patent Office Re. Application No. 08867385.0.
Response Dated Jun. 21, 2011 to Communication Pursuant to Article 94(3) EPC of Dec. 21, 2010 From the European Patent Office Re. Application No. 08866783.7.

Translation of Office Action Dated Jul. 1, 2011 From the State Intellectual Property Office of the People's Republic of China Re. Application No. 200880017707.6.
Translation of Office Action Dated Jun. 22, 2011 From the State Intellectual Property Office of the People's Republic of China Re. Application No. 200880127685.9.
Written Opinion Dated Jun. 2, 2009 From the International Searching Authority Re.: Application No. PCT/IL2008/001683.
Written Opinion Dated Apr. 14, 2009 From the International Searching Authority Re.: Application No. PCT/IL2008/001684.
Written Opinion Dated May 18, 2009 From the International Searching Authority Re.: Application No. PCT/IL2008/001685.
Agostini et al. "Evaluation of Feature-Based Registration in Dynamic Infrared Imaging for Breast Cancer Diagnosis", Proceedings of the 28th IEEE EMBS (Engineering in Medicine and Biology) Annual International Conference, New York City, USA Aug. 30-Sep. 3, 2006, XP031235634, p. 953-956, p. 953, § 2, 3.
Aksenov et al. "3D Thermography for Quantification of Heat Generation Resulting From Inflammation", Proceedings of the 8th 3D Modelling Symposium, Paris, France, XP))2523191, 11 P., 2003.
Bichinho et al. "A Computer Tool for the Fusion and Visualization of Thermal and Magnetic Resonance Images", Journal of Digital Imaging, XP002527797, 22(5): 527-534, Oct. 2009. p. 3, col. 1, Line 5-col. 2, Line 6, Fig.1.
Deng et al. "Enhancement of Thermal Diagnostics on Tumors Underneath the Skin by Induced Evaporation", Proceedings of the 2005 27th Annual International Conference of the Engineering in Medicine and Biology Society, Shanghai, China, Sep. 1-4, 2005, IEEE—EMBS 2005, XP002519610, 7: 7525-7528, 2005. Passage Bridging p. 7526 and p. 7527, Abstract, Figs.4, 5. Deng et al. "Mathematical Modeling of Temperature Mapping Over Skin Surface and Its Implementation in Thermal Disease Diagnostics", Computers in Biology and Medicine, XP002523192, 34(6): 495-521, Sep. 2004. Abstract, p. 497.
Good et al. "Can Less Yield More? Is Reducing Nutrient Input Into the Environment Compatible With Maintaining Crop Production?", Trends in Plant Science, 9(12): 597-605, Dec. 2004.
Good et al. "Engineering Nitrogen Use Efficiency With Alanine Aminotransferase", Canadian Journal of Botany, 85: 252-262, 2007.
Kaczmarek et al. "Optical Excitation Methods in Active Dynamic Thermography in Medical Diagnostics", Proceedings of the SPIE—The International Society for Optical Engineering SPIE, XP002519609, 5566(1): 120-126, 2004. p. 121, Last §, p. 123, First §, Fig.3.
Lipari et al. "Advanced Infrared Image Processing for Breast Cancer Risk Assessment", Proceedings of the 19th Annual International Conference of the IEEE/EMBS Engineering in Medicine and Biology Society, Chicago, IL, USA, Oct. 30-Nov. 2, 1997, XP010325780, 2: 673-676, Abstract, Sections II, III, Fig.3.
Moderhak et al. "Problems of 3D Breast Imaging", Gdansk University of Technology, Department of Biomedical Engineering, 2 P., 2008.
Tan et al. "A Novel Cognitive Interpretation of Breast Cancer Thermography With Complementary Learning Fuzzy Neural Memory Structure", Expert Systems With Applications, XP005919120, 33(3): 652-666, Mar. 13, 2007. Abstract, p. 658-659, Section 4, Fig.5.
Yanagisawa et al. "Metabolic Engineering With Dofl Transcription Factor in Plants: Improved Nitrogen Assimilation and Growth Under Low-Nitrogen Conditions", Proc. Natl. Acad. Sci. USA, PNAS, 101(20): 7833-7838, May 18, 2004.
International Search Report and the Written Opinion Dated Sep. 7, 2010 From the International Searching Authority Re. Application No. PCT/IB10/50871.
Invitation to Pay Additional Fees Dated Jun. 9, 2011 From the International Searching Authority Re. Application No. PCT/IB10/56023.
Gaxiola et al. "Drought- and Salt-Tolerant Plants Result From Overexpression of the AVP1 H+-Pump", Proc. Natl. Acad. Sci. USA, PNAS, 98(20): 11444-11449, Sep. 25, 2001.
Gowik et al. "cis-Regulatory Elements for Mesophyll-Specific Gene Expression in the C4 Plant *Flaveria trinervia*, the Promoter of the C4 Phosphoenolpyruvate Carboxylase Gene", The Plant Cell, 16: 1077-1090, 2004.
Hattori et al. "An Acetohydroxy Acid Synthase Mutant Reveals a Single Site Involved in Multiple Herbicide Resistance", Molecular and General Genetics, 246: 419-425, 1995. Abstract!
Holmström et al. "Drought Tolerance in Tobacco", Nature, 379: 683-684, 1996. Abstract!
Jiao et al.
Katavic et al. "Utility of the *Arabidopsis* FAE1 and Yeast SLC1-1 Genes for Improvements in Erucic Acid and Oil Content in Rapeseed", Biochemical Society Transactions, 28: 935-7, 2000. Abstract!
Pilon-Smits et al. "Improved Performance of Transgenic Fructan-Accumulating Tobacco under Drought Stress", Plant Physiology, 107: 125-130, 1995.
Quesada et al. "Genetic Architecture of NaCl Tolerance in *Arabidopsis*", Plant Physiology, 130: 951-963, 2002. Abstract!
Saijo et al. "Over-Expression of a Single Ca 2+-Dependent Protein Kinase Confers Both Cold and Salt/Drought Tolerance on Rice Plants", The Plant Journal 23(3): 319-327, 2000.
Skriver et al. "Cis-Acting DNA Elements Responsive to Gibberellin and Its Antagonist Abscisic Acid", Proceedings of the National Academy of Sciences USA 88: 7266-7270, 1991.
Tarczynski et al. "Stress Protection of Transgenic Tobacco by Production of the Osmolyte Mannitol", Science, 259: 508-510, 1993. Abstract!
van Haaren et al. "A Functional Map of the Fruit-Specific Promoter of the Tomato 2A11 Gene", Plant Molecular Biology, 21: 625-640, 1993. Abstract!
Vigcolas et al. "Increasing Seed Oil Content in Oil-Seed Rape (*Brassica napus* L.) by Over-Expression of a Yeast Glycerol-3-Phosphate Dehydrogenase Under the Control of a Seed-Specific Promoter", Plant Biotechnology Journal, 5 Issue: 431-441, 2007. Abstract!
Wang et al. The Soybean Dof-Type Transcription Factor Genes, GmDof4 and GmDof11, Enhance Lipid Content in the Seeds of Transgenic *Arabidopsis* Plants, The Plant Journal, 52: 716-729, 2007. Abstract!
Xu et al. "Expression of a Late Embryogenesis Abundant Protein Gene, HVA1 , From Barley Confers Tolerance to Water Deficit and Salt Stress in Transgenic Rice", Plant Physiology, 110: 249-257, 1996.
Yanagisawa et al. "Diversity and Similarity Among Recognition Sequences of Dof Transcription Factors", The Plant Journal, 17(2): 209-214, 1999.
Zabrouskov et al. "Oxidative Metabolism and the Physiological Age of Seed Potatoes Are Affected by Increased Alpha-Linolenate Content", Physiologia Plantarum, 116: 172-185, 2002.
Communication Pursuant to Rule 58 EPC or Rule 159 EPC, Invitation to Remedy Deficiencies in the Application Documents Dated Jan. 19, 2012 From the European Patent Office Re. Application No. 11190922.2.
Communication Pursuant to Rules 70(2) and 70a(2) EPC Dated Jan. 19, 2012 From the European Patent Office Re. Application No. 09807983.3.
International Search Report Dated Jun. 2, 2009 From the International Searching Authority Re.: Application No. PCT/IL2008/001683.
International Search Report Dated Apr. 14, 2009 From the International Searching Authority Re.: Application No. PCT/IL2008/001684.
Agostini et al. "Evaluation of Feature-Based Registration in Dynamic Infrared Imaging for Breast Cancer Diagnosis", Proceedings of the 28th IEEE EMBS (Engineering in Medicine and Biology) Annual International Conference, New York City, USA Aug. 30-Sep. 3, 2006, XP031235634, p. 953-956, Aug. 30, 2006. p. 953, § 2, 3.
Akscnov et al. "3D Thermography for Quantification of Heat Generation Resulting From Inflammation", Proceedings of the 8th 3D Modelling Symposium, Paris, France, XP))2523191, 11 P., 2003.
Deng et al. "Enhancement of Thermal Diagnostics on Tumors Underneath the Skin By Induced Evaporation", Proceedings of the 2005 27th Annual International Conference of the Engineering in Medicine and Biology Society, Shanghai, China, Sep. 1-4, 2005, IEEE—EMBS 2005, XP002519610, 7: 7525-7528, 2005. Passage Bridging p. 7526 and p. 7527, Abstract, Figs.4, 5.

Deng et al. "Mathematical Modeling of Temperature Mapping Over Skin Surface and Its Implementation in Thermal Disease Diagnostics", Computers in Biology and Medicine, XP002523192, 34(6): 495-521, Sep. 2004. Abstract, p. 497.
Communication Pursuant to Rules 70(2) and 70a(2) EPC Dated May 7, 2012 From the European Patent Office Re. Application No. 09823171.5.
Examination Report Dated Sep. 14, 2012 From the Australian Government IP Australia Re. Application No. 2007335706.
Examination Report Dated Jun. 25, 2012 From the Instituto Mexican de la Propicdad Industrial Re. Application No. MX/a/2011/003575 and Its Translation Into English.
International Preliminary Report on Patentability Dated Apr. 12, 2012 From the Interantional Bureau of WIPO Re. Application No. PCT/IB2010/052545.
International Preliminary Report on Patentability Dated May 12, 2011 From the International Bureau of WIPO Re. Application No. PCT/IB2009/054774.
International Search Report and the Written Opinion Dated Jun. 2, 2010 From the International Searching Authority Re.: Application No. PCT/IB09/54774.
International Search Report and the Written Opinion Dated Sep. 6, 2012 From the International Searching Authority Re. Application No. PCT/IB2011/055854.
International Search Report and the Written Opinion Dated Mar. 16, 2012 From the International Searching Authority Re. Application No. PCT/IB2010/052545.
Invitation to Pay Additional Fees Dated Jun. 15, 2012 From the International Searching Authority Re. Application No. PCT/IB2011/055854.
Invitation to Pay Additional Fees Dated Dec. 27, 2011 From the International Searching Authority Re. Application No. PCT/IB2010/052545.
Supplementary European Search Report and the European Search Opinion Dated Apr. 18, 2012 From the European Patent Office Re. Application No. 09823171.5.
Translation of Examination Report Dated Sep. 6, 2010 From the Government of the People's Republic of Bangladesh, Department of Patents, Designs and Trademarks, Ministry of Industries Re. Application No. 275/2009.
Translation of Office Action Dated Sep. 13, 2012 From the State Intellectual Property Office of the People's Republic of China Re. Application No. 200910217137.1.
Bautista et al. "*Arabidopsis thaliana* At5g06690 mRNA, Complete Cds", Unpublished, The Salk Institute for Biological Studies, La Jolla, CA, USA, GenBank: BT029447, Nov. 15, 2006.
Castelli et al. "*Arabidopsis thaliana* Full-Length cDNA Complete Sequence From Clone GSLTFB52ZA10 of Flowers and Buds of Strain Co1-0 of *Arabidopsis thaliana* (Thale Cress)", GeneBank Direct Submission BX829993, Accession No. BX829993, Feb. 6, 2004.
Matsumoto et al. "*Hordeum vulgare* Subsp. Vulgare, Full-Length cDNA", UniProtKB/TrEMBL, ID: F2DLE8-HORVD, UniProt Accession No. F2DLE8, May 31, 2011.
Rounsley et al. "*Arabidopsis thaliana* Chromosome 2 Clone T2P4 Map CIC10A06, Complete Sequence", Database EMBL [Online], XP002673500, Retrieved From EBI Accession No. EMBL:AC002336, Database Accession No. AC002336, Jul. 18, 1997. Sequence.
Takahashi et al. "The DNA Replication Checkpoint Aids Survival of Plants Deficient in the Novel Replisome Factor ETG1", The EMBO Journal, XP002537888, 27(13): 1840-1851, Jul. 9, 2008 & Supplementary Materials and Methods. Suppl. Fig.S6, p. 1844-1845.
Response Dated Sep. 13, 2010 to Office Action Dated May 13, 2010 From the Israel Patent Office Re. Application No. 180022.
Communication Pursuant to Rule 70(2) EPC and Reference to Rule 39(1) EPC Dated Sep. 13, 2010 From the European Patent Office Re.: Application No. 09163033.5.
Response Dated Sep. 21, 2010 to Notice of Allowance of Apr. 16, 2010 From the US Patent and Trademark Office Re.: U.S. Appl. No. 11/629,411.
Response Dated Oct. 12, 2010 to Communication Pursuant to Article 94(3) EPC of May 12, 2010 From the European Patent Office Re.: Application No. 06766224.7.
Response Dated Oct. 14, 2010 to Office Action of Jun. 17, 2010 From the Israel Patent Office Re. Application No. 190918.
Communication Pursuant to Article 94(3) EPC Dated Nov. 8, 2010 From the European Patent Office Re.: Application No. 04734072.4.
Communication Pursuant to Article 94(3) EPC Dated Nov. 19, 2010 From the European Patent Office Re.: Application No. 06809784.9.
Examination Report Dated Nov. 3, 2010 From the Government of India, Patent Office Re.: Application No. 158/CHENP/2007.
Examination Report Dated Sep. 22, 2010 From the Instituto Mexican de la Propriedad Industrial Re. Application No. MX/a/2008/005280 and Its Summary Into English.
International Search Report and the Written Opinion Dated Feb. 17, 2010 From the International Searching Authority Re.: Application No. PCT/IL09/00508.
Invitation to Pay Additional Fees Dated Nov. 19, 2009 From the International Searching Authority Re.: Application No. PCT/IL09/00508.
Office Action Dated Oct. 18, 2010 From the Israel Patent Office Re. Application No. 180022 and Its Translation Into English.
Yamada e tal. "*Arabidopsis thaliana* Clone RAFL14-87-A16 (R20399) Unknown Protein (At1g60770) mRNA, Complete Cds", GenBank Accession No. BT002876, Retrieved From the internet, Jan. 21, 2010.
Decision on Granting a Patent for Invention Dated Dec. 7, 2010 From the ROSPATENT, Federal State Institution, Federal Institute for Industrial Property of the Federal Service for Intellectual Property, Patents and Trademarks of the Russian Federation Re. Application No. 2008120395 and Its Translation Into English.
Notice of Grant Dated Jan. 14, 2011 From the Instituto Mexicano de la Propriedad Industrial Re. Application No. MX/a/2008/005280.
Examiner's Report Dated Jan. 13, 2011 From the Australian Patent Office Re.: Application No. 2005252469.
Response Dated Jan. 19, 2011 to Supplementary European Search Report and the European Search Opinion of Jul. 1, 2010 From the European Patent Office Re. Application No. 07849616.3.
Blewitt et al. "*Gossypium hirsutum* Strain Acala Maxxa BURP Domain-Containing Protein (BNL1924) mRNA, Complete CDS", GenBank Nucleotide, GenBank Accession No. AY343972, Aug. 16, 2003.
Li et al. "Isolation of Genes Preferntially Expressed in Cotton Fibers by cDNA Filter Arrays and RT-PCR", Plant Science, 163: 1113-1120, 2002. & GenBank Nucleotide "*Gossypium hirstutum* Dehydration-Iduced Protein RD22-Like Protein (RDL0 mRNA, Complete CDS", GenBank Accession No. AY072821, Dec. 4, 2002.
Office Action Dated Feb. 3, 2011 From the Israel Patent Office Re.: Application No. 172135 and Its Translation Into English.
Official Action Dated Feb. 15, 2011 From the US Patent and Trademark Office Re. U.S. Appl. No. 12/448,359.
International Preliminary Report on Patentability Dated Mar. 3, 2011 From the International Bureau of WIPO Re.: Application No. PCT/IB2009/053633.
International Search Report and the Written Opinion Dated Jun. 2, 2010 From the International Searching Authority Re. Application No. PCT/IB09/53633.
Invitation to Pay Additional Fees Dated Mar. 2, 2010 From the International Searching Authority Re.: Application No. PCT/IB09/53633.
Communication Pursuant to Article 94(3) EPC Dated Mar. 8, 2011 From the European Patent Office Re.: Application No. 06809784.9.
Communication Pursuant to Article 94(3) EPC Dated Mar. 14, 2011 From the European Patent Office Re. Application No. 07849616.3.
Response Dated Feb. 9, 2011 to Communication Pursuant to Article 94(3) EPC of Nov. 19, 2010 From the European Patent Office Re.: Application No. 06809784.9.
Response Dated Feb. 14, 2011 to Supplementary European Search Report and the European Search Opinion of Jul. 29, 2010 From the European Patent Office Re. Application No. 08776651.5.
Response Dated Mar. 14, 2011 to Official Action of Feb. 15, 2011 From the US Patent and Trademark Office Re. U.S. Appl. No. 12/448,359.

Communciation Pursuant to Rules 70(2) and 70a(2) EPC Dated Aug. 30, 2011 From the European Patent Office Re. Application No. 08738191.9.
Response Dated Feb. 23, 2011 to Communication Pursuant to Rule 70(2) EPC and Reference to Rule 39(1) EPC of Sep. 13, 2010 From the European Patent Office Re.: Application No. 09163033.5.
Response Dated Feb. 24, 2011 to Communciation Pursuant to Rules 70(2) and 70a(2) EPC of Aug. 30, 2011 From the European Patent Office Re. Application No. 08738191.9.
Examiner's Report Dated Mar. 31, 2011 From the Australian Government, IP Australia Re.: Application No. 2005252469.
Response Dated Mar. 8, 2011 to Examiner's Report of Jan. 13, 2011 From the Australian Government, IP Australia Re.: Application No. 2005252469.
Response Dated Mar. 9, 2011 to Office Action of Nov. 11, 2010 From the Israel Patent Office Re. Application No. 206118.
Response Dated Mar. 23, 2011 to Official Action of Nov. 23, 2010 From the US Patent and Trademark Office Re. U.S. Appl. No. 12/083,978.
Response Dated Mar. 24, 2011 to Examination Report of Nov. 3, 2010 From the Government of India, Patent Office Re.: Application No. 158/CHENP/2007.
Official Action Dated May 10, 2011 From the US Patent and Trademark Office Re. U.S. Appl. No. 12/457,199.
Official Action Dated Apr. 29, 2011 From the US Patent and Trademark Office Re. U.S. Appl. No. 12/448,359.
Response Dated Apr. 21, 2011 to Communication Pursuant to Article 94(3) EPC of Nov. 8, 2010 From the European Patent Office Re.: Application No. 04734072.4.
Supplementary European Search Report and the European Search Opinion Dated May 6, 2011 From the European Patent Office Re. Application No. 09750276.9.
Payne et al. "Heterologous MYB Genes Distinct From GL1 Enhance Trichome Production When Overexpressed in *Nicotiana tabacum*", Development, 126: 671-682, 1999.
Sunkar et al. "Small RNAs as Rig Players in Plant Abiotic Stress Responses and Nutrient Deprivation", Trends in Plant Science XP022148764, 12(7): 301-309, Jul. 1, 2007.
Communication Pursuant to Rules 70(2) and 70a(2) EPC Dated May 24, 2011 From the European Patent Office Re. Application No. 09750276.9.
Examination Report Dated Apr. 19, 2011 From the Instituto Mexican de la Propriedad Industrial Re. Application No. MX/a/2008/002262 and Its Summary Into English.
Requisition by the Examiner Dated Jun. 15, 2011 From the Canadian Intellectual Property Office Re. Application No. 2,526,440.
Communication Pursuant to Article 94(3) EPC Dated Jun. 29, 2011 From the European Patent Office Re. Application No. 08738191.9.
Response Dated Jun. 2, 2011 to Office Action of Feb. 3, 2011 From the Israel Patent Office Re.: Application No. 172135.
Examiner's Report Dated Dec. 20, 2011 From the Australian Government, IP Australia Re. Application No. 2005234725.
Examiner's Report Dated Jun. 24, 2011 From the Australian Government, IP Australia Re. Application No. 2006281018.
Examiner's Report Dated Jun. 30, 2011 From the Australian Government, IP Australia Re. Application No. 2006307457.
Office Action Dated Jun. 19, 2011 From the Israel Patent Office Re. Application No. 199391 and Its Translation Into English.
Response Dated Jun. 9, 2011 to Examiner's Report of Dec. 20, 2011 From the Australian Government, IP Australia Re. Application No. 2005234725.
European Search Report and the European Search Opinion Dated Jun. 14, 2011 From the European Patent Office Re. Application No. 11154193.4.
European Search Report and the European Search Opinion Dated Jun. 21, 2011 From the European Patent Office Re. Application No. 11154213.0.
Office Action Dated Jun. 20, 2011 From the Israel Patent Office Re. Application No. 190918 and Its Translation Into English.
Partial European Search Report Dated Jul. 12, 2011 From the European Patent Office Re. Application No. 10194223.3.
Response Dated Jun. 15, 2011 to Examiner's Report of Mar. 31, 2011 From the Australian Government, IP Australia Re.: Application No. 2005252469.
Li et al. "*Gossypium hirsutum* Dehydration-Induced Protein RD22-Like Protein (RDL) mRNA, Complete CDS", EBI Accession No. EMBL:AY072821, XP002639385, Database Accession No. AY072821, Dec. 4, 2002. Compound.
Purnelle et al. "*Arabidopsis thaliana* DNA Chromosome 3, BAC Clone F3C22", Database EMBL [Online], XP002640829, Retrieved From EBI Accession No. EMBL:AL353912, Database Accession No. AL 353912, Apr. 27, 2000. Compound.
Wing et al. "GA_Eb0026P18f *Gossypium arboreum* 7-10 Dpa Fiber Library *Gossypium arboreum* cDNA Clone GA_Eb0026P18f, mRNA Sequence", Database EMBL [Online], XP002640830, Retrieved From EBI Accession No. EMBL:BF277249, Database Accession No. BF277249, Nov. 20, 2000.
Yamada et al. "*Arabidopsis thaliana* Unknown Proein (At3g51610) mRNA, Complete CDS", Database EMBL [Online], XP002640828, Retrieved Fom EBI Accession No. EMBL:AY034915, Database Accession No. AY034915, Jun. 13, 2001. Compound.
Official Action Dated Jul. 8, 2011 From the US Patent and Trademark Office Re. U.S. Appl. No. 12/083,978.
Response Dated Jun. 17, 2011 to Examiner's Report of Mar. 31, 2011 From the Australian Government, IP Australia Re.: Application No. 2005252469.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 18, 2011 From the European Patent Office Re. Application No. 11154193.4.
Communication Pursuant to Rule 69 EPC—Reminder Concerning Payment of the Designation Fee (Art. 79(2) EPC) and of the Examination Fee (Art. 94(1) EPC)—and Invitation Pursuant to Rule 70a(1) EPC Dated Jul. 25, 2011 From the European Patent Office Re. Application No. 11154213.0.
Examiner's Report Dated Jul. 21, 2011 From the Australian Government, IP Australia Re. Application No. 2005234725.
Response Dated Jul. 3, 2011 to Examination Report of Apr. 19, 2011 From the Instituto Mexicano de la Propriedad Industrial Re. Application No. MX/a/2008/002262 and Its Summary Into English.
Response Dated Jun. 6, 2011 to Official Action of May 10, 2011 From the US Patent and Trademark Office Re. U.S. Appl. No. 12/457,199.
Response Dated Jul. 25, 2011 to Examiner's Report of Jul. 21, 2011 From the Australian Government, IP Australia Re. Application No. 2005234725.
Examiner's Report Dated Aug. 1, 2011 From the Australian Government, IP Australia Re. Application No. 2005234725.
Van der Hoeven et al. "EST312975 Tomato Root During/After Fruit Set, Cornell University Solanum Lycopersicum cDNA Clone cLEX14O20 5-, mRNA Sequence", GenBank, GenBank Accession No. AW622177.1.
Advisory Action Before the Filing of an Appeal Brief Dated Aug. 5, 2011 From the US Patent and Trademark Office Re. U.S. Appl. No. 12/083,978.
Invitation to Pay Additional Fees Dated Aug. 18, 2011 From the International Searching Authority Re.: Application No. PCT/IL08/00489.
Katavic et al. "Utility of the *Arabidopsis* FAE1 and Yeast SLC1-1 Genes for Improvement in Erucic Acid and Oil Content in Rapeseed", Biochemical Society Transaction, 28(6): 935-937, Dec. 2000.
International Preliminary Report on Patentability Dated Sep. 15, 2011 From the International Bureau of WIPO Re. Application No. PCT/IB2010/050871.
Official Action Dated Aug. 22, 2011 From the US Patent and Trademark Office Re. U.S. Appl. No. 12/457,199.
Johansson et al. "The Role of Aquaporins in Cellular and Whole Plant Water Balance," Biochimica et Biophysica Acta 1465: 324-342, 2000.
Whisstock et al. "Prediction of Protein Function from Protein Sequence and Structure," Quarterly Reviews of Biophysics 36 (3): 307-340, Aug. 2003.
Taliercio et al. "GH_TMIRS_129_G10_F Cooton Normalized Library dT Primed *Gossypium hirsutum* cDNA, mRNA Sequence", EMBL-Bank, XP002659970, Retrieved From EBI Accession No. EM_EST:DW508992, Database Accession No. DW508992.
Taliercio et al. "GH_TMTRS_129_G10_R Cotton Normalized Library dT Primed *Gossypium hirsutum* cDNA, mRNA Sequence", EMBL-Bank, XP002659971, Retrieved From EBI Accession No. EM_EST:DW508993, Database Accession No. DW508993.
International Preliminary Report on Patentability Dated Dec. 1, 2011 From the International Bureau of WIPO Re. Application No. PCT/IL2008/000489.
Lin et al. "*Arabidopsis thaliana* Chromosome III BAC F7O18 Genomic Sequence, Complete Sequence", GenBank Accession No. AC011437, Oct. 30, 2002.
Communication Pursuant to Rules 70(2) and 70a(2) EPCc and Reference to Rule 39(1) EPC Dated Dec. 5, 2011 From the European Patent Office Re. Application No. 10194223.3.
Communication Pursuant to Rules 70(2) and 70a(2) EPC and Reference to Rule 39(1) EPC Dated Nov. 7, 2011 From the European Patent Office Re. Application No. 11172514.9.
Examiner's Report Dated Jan. 10, 2012 From the Australian Government, IP Australia Re. Application No. 2005234725.
Official Action Dated Dec. 21, 2011 From the US Patent and Trademark Office Re. U.S. Appl. No. 12/810,855.
Response Dated Jan. 10, 2012 to European Search Report and the European Search Opinion of Jun. 14, 2011 From the European Patent Office Re. Application No. 11154193.4.
Aharon et al. "Overexpression of a Plasma Membrane Aquaporin in Transgenic Tobacco Improves Plant Vigor Under Favorable Growth Conditions But Not Under Drought or Salt Stress", The Plant Cell, 15: 439-447, Feb. 2003.
Davletova et al. "The Zinc-Finger Protein Zat12 Plays a Central Role in Reactive Oxygen and Abiotic Stress Signaling in *Arabidopsis*", Plant Physiology, 139: 847-856, Oct. 2005.
Friedberg "Automated Protein Function Prediction—The Genomic Challenge", Briefings in Bioinformatics, 7(3): 225-242, 2006.
Examiner's Report Dated Jan. 13, 2012 From the Australian Government, IP Australia Re. Application No. 2011239323.
Response Dated Dec. 22, 2011 to Official Action of Aug. 22, 2011 From the US Patent and Trademark Office Re. U.S. Appl. No. 12/457,199.
Supplementary European Search Report and the European Search Opinion Dated Jan. 2, 2012 From the European Patent Office Re. Application No. 09807983.3.
Translation of Decision of Rejection Dated Dec. 9, 2011 From the State Intellectual Property Office of the People's Republic of China Re.: Application No. 200580027481.4.
Adachi et al. "Oryza Sativa Japonica Group cDNA Clone:J023021L06, Full Insert Sequence", Database EMBASE [Online], XP002665608, Retrieved From EBI, Database Accession No. AK099270, Jul. 19, 2003.
Feng et al. "Probable Cinnamyl Alcohol Dehydrogenase 6", Darabase UniProt [Online], XP002665609, Retrieved From EBI, Database Accession No. Q7XWU3, Mar. 1, 2004.
Response Dated Sep. 25, 2011 to Examiner's Report of Jun. 30, 2011 From the Australian Government, IP Australia Re. Application No. 2006307457.
Office Action Dated Sep. 22, 2011 From the Israeli Patent Office Re. Application No. 201242 and Its Translation Into English.
Response Dated Oct. 17, 2011 to Requisition by the Examiner of Jun. 15, 2011 From the Canadian Intellectual Property Office Re. Application No. 2,526,440.
Response Dated Oct. 18, 2011 to Official Action of Sep. 19, 2011 From the US Patent and Trademark Office Re. U.S. Appl. No. 12/810,855.
Examination Report Dated Dec. 19, 2011 From the Federal Service of Intellectual Property, Federal State Budget Institute, Federal Institute of Industrial Property of the Russian Federation Re. Application No. 2011113420 and Its Translation Into English.
Translation of Office Action Dated Jan. 4, 2012 From the State Intellectual Property Office of the People's Republic of China Re. Application No. 200880109464.9.
Translation of Office Action Dated Jan. 17, 2012 From the State Intellectual Property Office of the People's Republic of China Re. Application No. 201110104274.1.
Translation of Office Action Dated Dec. 31, 2011 From the State Intellectual Property Office of the People's Republic of China Re. Application No. 200910217137.1.
Communication Pursuant to Rule 55 EPC Dated Mar. 16, 2012 From the European Patent Office Re. Application No. 11190921.4.
Restriction Official Action Dated Apr. 11, 2012 From the US Patent and Trademark Office Re. U.S. Appl. No. 12/834,106.
Communication Pursuant to Article 94(3) EPC Dated Apr. 3, 2012 From the European Patent Office Re.: Application No. 06766224.7.
Restriction Official Action Dated Feb. 1, 2012 From the US Patent and Trademark Office Re. U.S. Appl. No. 12/669,975.
International Search Report and the Written Opinion Dated Dec. 6, 2011 From the International Searching Authority Re. Application No. PCT/IB2011/051843.
Notice of Allowance Dated Dec. 5, 2011 From the US Patent and Trademark Office Re. U.S. Appl. No. 12/448,359.
Response Dated Dec. 15, 2011 to Examiner's Report of Aug. 1, 2011 From the Australian Government, IP Australia Re. Application No. 2005234725.
Response Dated Dec. 19, 2011 to Examiners Report of Oct. 19, 2011 From the Australian Government, IP Australia Re. Application No. 2006281018.
Response Dated Jun. 29, 2011 to Communication Pursuant to Article 94(3) EPC of Mar. 8, 2011 From the European Patent Office Re.: Application No. 06809784.9.
International Search Report and the Written Opinion Dated Aug. 22, 2011 From the International Searching Authority Re: Application No. PCT/IB2010/56023.
Yanagisawa et al. "Metabolic Engineering With Dof1 Transcription Factor in Plants: Improved Nitrogen Assimilation and Growth Under Low-Nitrogen Conditions", Proc. Natl. Acad. Sci USA, PNAS, 101(20): 7833-7838, May 18, 2004.
Examiner's Report Dated Jan. 31, 2012 From the Australian Government, IP Australia Re. Application No. 2006281018.
Office Action Dated Jan. 2, 2012 From the Israel Patent Office Re. Application No. 206118 and Its Translation Into English.
Invitrogen "SuperScript® Plasmid System With Gateway® Technology for cDNA Synthesis and Cloning", Invitrogen by Life Technologies, User Manual, Catalog No. 18248-013, Manual Part No. 11108, 44 P., Dec. 22, 2010.
Communication Pursuant to Article 94(3) EPC Dated Feb. 14, 2012 From the European Patent Office Re.: Application No. 04734072.4.
Requisition by the Examiner Dated Feb. 2, 2012 From the Canadian Intellectual Property Office Re. Application No. 2,570,195.
Official Action Dated Apr. 10, 2012 From the US Patent and Trademark Office Re. U.S. Appl. No. 12/669,975.
Examiner's Report Dated Mar. 15, 2012 From the Australian Government, IP Australia Re. Application No. 2011239323.
European Search Report and the European Search Opinion Dated Nov. 2, 2011 From the European Patent Office Re. Application No. 10194223.3.
Examiner's Report Dated Oct. 19, 2011 From the Australian Government, IP Australia Re. Application No. 2006281018.
Examiner's Report Dated Oct. 28, 2011 From the Australian Government, IP Australia Re. Application No. 2006307457.
International Search Report and the Written Opinion Dated Oct. 31, 2011 From the International Searching Authority Re.: Application No. PCT/IL08/00489.
Response Dated Oct. 19, 2011 to Official Action of Apr. 29, 2011 From the US Patent and Trademark Office Re. U.S. Appl. No. 12/448,359.
Response Dated Oct. 27, 2011 to Communication Pursuant to Article 94(3) EPC of Jun. 29, 2011 From the European Patent Office Re. Application No. 08738191.9.
Response Dated Oct. 27, 2011 to Office Action of Jul. 1, 2011 From the State Intellectual Property Office of the People's Republic of China Re. Application No. 200880017707.6.
Response Dated Oct. 27, 2011 to Supplementary European Search Report and the European Search Opinion of May 6, 2011 From the European Patent Office Re. Application No. 09750276.9.

Response Dated Oct. 31, 2011 to Notification of the First Office Action of Jun. 30, 2011 From the State Intellectual Property Office of the People's Republic of China Re. Application No. 200680047610.0.
Kandel et al. "Cloning, Functional Expression, and Characterization of CYP709C1, the First Sub-Terminal Hydroxylase of Long Chain Fatty Acid in Plants", Journal of Biological Chemistry, JBC, 280(43): 35881-35889, Oct. 28, 2005. p. 35887, col. 1, Para 2.
Translation of Notification of the Office Action Dated Dec. 1, 2011 From the State Intellectual Property Office of the People's Republic of China Re. Application No. 200680047610.0.
Official Action Dated Sep. 19, 2011 From the US Patent and Trademark Office Re. U.S. Appl. No. 12/810,855.
Notice of Allowance Dated Nov. 19, 2012 From the US Patent and Trademark Office Re. U.S. Appl. No. 13/450,547.
Communication Pursuant to Article 94(3) EPC Dated Dec. 19, 2012 From the European Patent Office Re.: Application No. 04734072.4.
Official Action Dated Dec. 18, 2012 From the US Patent and Trademark Office Re. U.S. Appl. No. 12/834,106.
Benfey et al. "The CaMV 35S Enhancer Contains at Least Two Domains Which Can Confer Different Development and Tissue-Specific Expression Patterns", The EMBO Journal, 8(8): 2195-2202, 1989.
Benfey et al. "The Cauliflower Mosaic Virus 35S Promoter: Combinatorial Regulation of Transcription in Plants", Science, 250(4983): 959-966, Nov. 16, 1990.
Communication Pursuant to Article 94(3) EPC Dated Jul. 4, 2012 From the European Patent Office Re. Application No. 10194223.3.
Examination Report Dated Jun. 6, 2012 From the Federal Service of Intellectual Property, Federal State Budget Institute, Federal Institute of Industrial Property of the Russian Federation Re. Application No. 2011113420 and Its Translation Into English.
Supplementary European Search Report and the European Search Opinion Dated Jul. 6, 2012 From the European Patent Office Re. Application No. 10748403.2.
Ishikawa et al. JP 2005-185101: Full Length cDNA of Plant and the Use Thereof, Database EMBL [Online], XP002678022, Retrieved From EBI Accession No. EM_PAT:IIV067703, Database Accession No. IIV067703, Jul. 15, 2011. Sequence.
Kikuchi et al. "Rice cDNA-Encoded Protein SEQ ID No. 31047", Database Geneseq [Online], XP002678021, Retrieved From EBI Accession No. GSP:AQD37188, Database Accession No. AGD37188, Jun. 12, 2008. Shows 100% Identity to Present SEG ID No. 246 (Protein) and Corresponding Polynucleotide Shows 100 % Identity to SEQ ID No. 7 Over 458 Nucleotides. Abstract.
La Rosa et al. "Oryza Sativa Amino Acid Sequence SEQ ID No. 133688", Database Geneseq [Online], XP002678023, Retrieved From EBI Accession No. GSP:ANM19687, Database Accession No. ANM19687, Dec. 28, 2007. 100% Identity to Present SEQ IFD No. 246, Corresponding Polynucleotide Has 99,6% Identity to Present SEQ ID No. 7 Over 488 Nucleotides. Abstract, Sequence.
La Rosa et al. "Oryza Sativa Nucleotide Sequence SEQ ID No. 31205", Database Geneseq [Online], X0002678024, Retrieved From EBI Accession No. GSN:ANL17203, Database Accession No. ANL17203, Dec. 28, 2007. Sequence.
Communication Under Rule 71(3) EPC Dated Nov. 19, 2012 From the European Patent Office Re. Application No. 08738191.9.
Communication Pursuant to Article 94(3) EPC Dated Jan. 3, 2013 From the European Patent Office Re. Application No. 09807983.3.
English Summary of Examination Results Dated Dec. 28, 2012 From the National Office of Intellectual Property (NOIP) of Vietnam Re. Application No. 1-2009-02358.
International Search Report and the Written Opinion Dated Jan. 7, 2013 From the International Searching Authority Re. Application No. PCT/IL2012/050154.
Invitation to Pay Additional Fees Dated Dec. 31, 2012 From the International Searching Authority Re. Application No. PCT/IL2012/050327.
Invitation to Pay Additional Fees Dated Oct. 17, 2012 From the International Searching Authority Re. Application No. PCT/IL2012/050154.
Communication Pursuant to Article 94(3) EPC Dated Oct. 23, 2012 From the European Patent Office Re. Application No. 11154193.4.
Requisition by the Examiner Dated Oct. 3, 2012 From the Canadian Intellectual Property Office Re. Application No. 2,526,440.
Translation of Notice of Paying Restoration Fee for Unity of Invention Dated Oct. 29, 2012 From the State Intellectual Property Office of the People's Republic of China Re. Application No. 200880127757.X.
Alcala et al. "EST543159 Tomato Callus Solanum Lycopersicum cDNA Clone cLEC80A19 5-end, mRNA Sequence", GenBank: BI923254.1, GenBank Accession No. BI923254, Oct. 17, 2001.
Restriction Official Action Dated Nov. 13, 2012 From the US Patent and Trademark Office Re. U.S. Appl. No. 12/992,902.
Backhaus et al. "Nucleotide Sequence of A cDNA for A P2 60S Acidic Ribosomal Protein From Parthenium Argentatum", Plant Physiology, 106: 395, 1994.
Del Pozo et al. "F-Box Proteins and Protein Degradation: An Emerging Theme in Cellular Regulation", Plant Molecular Biology, 44(2): 123-128, Sep. 2000.
Harwood "Plant Fatty Acid Synthesis", The AOCS Lipid Library, 11 P., Apr. 12, 2010.
Communication Pursuant to Article 94(3) EPC Dated Oct. 23, 2012 From the European Patent Office Re. Application No. 11154213.0.
Examination Report Dated Oct. 15, 2012 From the Instituto Mexicano de la Propiedad Industrial Re. Application No. MX/a/2009/006660 and Its Translation Into English.
Patent Examination Report Dated Dec. 12, 2012 From the Australian Government, IP Australia Re. Application No. 2008236316.
Communication Under Rule 71(3) EPC Dated Jun. 5, 2012 From the European Patent Office Re.: Application No. 06809784.9.
Official Action Dated Jun. 19, 2012 From the US Patent and Trademark Office Re. U.S. Appl. No. 13/450,547.
Communication Pursuant to Article 94(3) EPC DAted Jul. 13, 2012 From the European Patent Office Re. Application No. 11172514.9.
Examination Report Dated Jun. 11, 2012 From the Instituto Mexicano de la Propiedad Industrial Re. Application No. MX/a/2011/007294 and Its Translation Into English.
Official Action Dated Jul. 17, 2012 From the US Patent and Trademark Office Re. U.S. Appl. No. 12/834,106.
Kano-Murakami et al. "A Rice Homeotic Gene, OSH1, Causes Unusual Phenotypes in Transgenic Tobacco", FEBS Letters, 334(3): 365-368, Nov. 1993.
Applicant-Initiated Interview Summary Dated Aug. 6, 2012 From the US Patent and Trademark Office Re. U.S. Appl. No. 12/669,975.
Communication Pursuant to Rules 70(2) and 70a(2) EPC Dated Jul. 24, 2012 From the European Patent Office Re. Application No. 10748403.2.
International Preliminary Report on Patentability Dated Jul. 12, 2012 From the International Bureau of WIPO Re. Application No. PCT/IB2010/056023.
Office Action Dated Jun. 25, 2012 From the State Intellectual Property Office of the People's Republic of China Re.: Application No. 200880109464.9 and Its Translation Into English.
International Search Report and the Written Opinion Dated Aug. 6, 2012 From the International Searching Authority Re. Application No. PCT/IB11/53697.
Daniell et al. "Solanum Bulbocastanum Chloroplast, Complete Genome", GenBank NCBI, Accession No. NC_007943, Mar. 26, 2010. p. 1, Source, p. 10-11, Nucleotides 46590-47195, Gene 'RPS4'.
Bernhardt et al. "The bHLH Genes GLABRA3 (GL3) and Enhancer of GLABRA3 (EGL3) Specify Epidermal Cell Fate in the *Arabidopsis* Root", Development, 130(26): 6431-6439, 2003.
Payne et al. "GL3 Encodes a bHLH Protein That Regulates Trichome Development in *Arabidopsis* Through Interaction With GL1 and TTG1", Genetics, 156: 1349-1362, Nov. 2000.
Advisory Action Before the Filing of an Appeal Brief Dated Aug. 29, 2012 From the US Patent and Trademark Office Re. U.S. Appl. No. 12/457,199.
Examination Report Dated Aug. 16, 2012 From the Instituto Mexicano de la Propiedad Industrial Re. Application No. MX/a/2010/014097 and Its Translation Into English.
Examination Report Dated Jun. 11, 2012 From the Instituto Mexicano de la Propiedad Industrial Re. Application No. MX/a/2011/007294 and Summary in English.

Examination Report Dated Dec. 7, 2012 From the Instituto Mexicano de la Propiedad Industrial Re. Application No. MX/a/2011/003575 and Its Translation Into English.
Patent Examination Report Dated Jan. 4, 2013 From the Australian Government, IP Australia Re. Application No. 2008344935.
Examination Report Dated Aug. 1, 2011 From the Government of India, Patent Office Re.: Application No. 158/CHENP/2007.
Examination Report Dated May 25, 2011 From the Government of India, Patent Office Re.: Application No. 158/CHENP/2007.
Examiner's Report Dated Aug. 1, 2011 From the Australian Government, IP Australia Government, IP Australia Re. Application No. 2005234725.
Response Dated Jul. 6, 2011 to Examiner's Report of Dec. 20, 2010 From the Australian Government, IP Australia Re. Application No. 2005234725.
Response Dated Jul. 20, 2011 to Examination Report of May 25, 2011 From the Government of India, Patent Office Re.: Application No. 158/CHENP/2007.
Translation of Notification of the First Office Action Dated Jun. 30, 2011 From the State Intellectual Property Office of the People's Republic of China Re. Application No. 200680047610.0.
Van der Hoeven et al. "EST312975 Tomato Root During/After Fruit Set, Cornell University Solanum Lycopersicum cDNA Clone cLEX14O20 5-, mRNA Sequence", GenBank, GenBank Accession No. AW622177.1, 2000.
European Search Report and the European Search Opinion Dated Oct. 6, 2011 From the European Patent Office Re. Application No. 11172514.9.
Response Dated Oct. 3, 2011 to Examiner's Report of Jun. 24, 2011 From the Australian Government, IP Australia Re. Application No. 2006281018.
Response Dated Oct. 4, 2011 to Official Action of Jul. 8, 2011 From the US Patent and Trademark Office Re. U.S. Appl. No. 12/083,978.
Chames et al. "Direct Selection of a Human Antibody Fragment Directed Against the Tumor T-Cell Epitope HLA-A1-MAGE-A1 From a Nonimmunized Phage-Fab Library", Proc. Natl. Acad. Sci. USA PNAS, XP002967292, 97(14): 7969-7974, Jul. 5, 2000. Abstract, p. 7970, 1-h col., § 3-r-h col., § 2, p. 7972, r-h col. Last §-p. 7973, 1-h col., p. 7973, r-h col., § 2., p. 7974, Fig.6.
Taliercio et al. "GH_TMIRS_129_G10_F Cooton Normalized Library dT Primed *Gossypium hirsutum* cDNA, mRNA Sequence", EMBL-Bank, XP002659970, Retrieved From EBI Accession No. EM_EST:DW508992, Database Accession No. DW508992, 2006.
Taliercio et al. "GH_TMIRS_129_G10_R Cotton Normalized Library dT Primed Gossypium Hirsutum cDNA, mRNA Sequence", EMBL-Bank, XP002659971, Retrieved From EBI Accession No. EM_EST:DW508993, Database Accession No. DW508993, 2006.
Translation of Office Action Dated Jan. 17, 2013 From the State Intellectual Property Office of the People's Republic of China Re. Application No. 201110104274.1.
Translation of Search Report Dated Jan. 17, 2013 From the State Intellectual Property Office of the People's Republic of China Re. Application No. 201101014274.1.
Communication Pursuant to Rules 70(2) and 70a(2) EPC Dated Aug. 30, 2010 From the European Patent Office Re. Application No. 08738191.9.
Examiner's Report Dated Dec. 20, 2010 From the Australian Government, IP Australia Re. Application No. 2005234725.
Notice of Allowance Dated Jan. 7, 2013 From the US Patent and Trademark Office Re. U.S. Appl. No. 12/457,199.
Official Action Dated Jan. 18, 2013 From the US Patent and Trademark Office Re. U.S. Appl. No. 12/669,975.
Communication Pursuant to Article 94(3) EPC Dated May 8, 2013 From the European Patent Office Re. Application No. 08776651.5.
Examination Report Dated Mar. 23, 2013 From the Government of India, Patent Office, Intellectual Property Building Re. Application No. 2570/CHENP/2008.
International Search Report and the Written Opinion Dated May 12, 2013 From the International Searching Authority Re. Application No. PCT/IL2013/050172.
Office Action Dated Apr. 1, 2013 From the State Intellectual Property Office of the People's Republic of China Re. Application No. 200880127757.X and Its Translation Into English.
Official Action Dated May 8, 2013 From the US Patent and Trademark Office Re. U.S. Appl. No 13/125,047.
Official Action Dated May 20, 2013 From the US Patent and Trademark Office Re. U.S. Appl. No 13/059,231.
Patent Examination Report Dated May 31, 2013 From the Australian Government, IP Australia Re. Application No. 2008278654.
Desveaux et al. "Whirly Transcription Factors: Defense Gene Regulation and Beyond", Trends in Plant Science, TiPS, 10(2): 95-102, Feb. 2005.
Hirner et al. "Arabidopsis LHT1 Is A High-Affinity Transporter for Cellular Amino Acid Uptake in Both Root Epidermis and Leaf Mesophyll", The Plant Cell, 18: 1931-1946, Aug. 2006.
Plant Energy Biology "Protein_Coding: Cationic Amino Acid Transporter 2 (TAIR10)", Plant Energy Biology: SUBA3 Flatfile for AT1G58030.1, Database, 1 P., 2007.
Rolletschek et al. "Ectopic Expression of an Amino Acid Transporter (VfAAP1) in Seeds of Vica Narbonensis and Pea Increases Storage Proteins", Plant Physiology, 137: 1236-1249, Apr. 2005.
Su et al. "Molecular and Functional Characterization of a Family of Amino Acid Transporter From Arabidopsis", Plant Physiology, 136: 3104-3113, Oct. 2004.
TAIR "Encodes A Member of the Cationic Amino Acid Transporter (CAT) Subfamily of Amino Acid Polyamine Choline Transporters. Localized to the Tonoplast", TAIR, Locus: AT1G58030, Tair Accession No. Locus:2196245, 4 P., 2013.
TAIR "Protein Kinase Superfamily Protein. Functions in: Protein Serine/Threonine Kinase Activity, Protein Kinase activity, Kinase Activity, ATP Binding ff.", TAIR, Locus: AT5G15080, TAIR Accession No. Locus:2147805, 4 P., 2013.
Young et al. "Hypothetical Protein MTR_7g116270 [Medicago Truncatula]", Database NCBI [Online], GenBank: AES82688.1, Database Accession No. AES82688, Nov. 21, 2011.
Zhang et al. "Phosphatidic Acid Regulates Microtubule Organization by Interaction With MAP65-1 in Response to Salt Stress in Arabidopsis", The Plant Cell, 24: 4555-4576, Nov. 2012.
Official Action Dated Jun. 24, 2013 From the US Patent and Trademark Office Re. U.S. Appl. No 12/992,902.
Patent Examination Report Dated Jun. 27, 2013 From the Australian Government, IP Australia Re. Application No. 2012216482.
Arabidopsis Genome Initiative "Analysis of the Genome Sequence of the Flowering Plant Arabicopsis Thaliana" Nature, 408: 796-815, Dec. 14, 2000.
Ciddi et al. "Elicitation of Taxus Sp. Cell Cultures for Production of Taxol", Biotechnology Letters, 17(12): 1343-1346, Dec. 1995.
Lurin et al. "Genome-Wide Analysis of Arabidopsis Pentatricopeptide Repeat Proteins Reveals Their Essential Role in Organelle Biogenesis", The plant Cell, 16: 2089-2103, Aug. 2004.
Matz et al. "Gossypium Hirsutum GHDEL65 (ghdel65) mRNA, Complete CDS", GenBank Nucleotide, GenBank Accession No. AF336280, Mar. 15, 2001.
Terminology "Frequently Asked Questions", Bioinformatics Website, Frequently Asked Questions, 2001.
Theologis et al. "Sequence and Analysis off Chromosome 1 of the Plant Arabidopsis Thaliana", Nature, 408: 816-820, Dec. 14, 2000.
Communication Pursuant to Article 94(3) EPC Dated May 29, 2013 From the European Patent Office Re. Application No. 09823171.5.
Patent Examination Report Dated Jun. 21, 2013 From the Australian Government, IP Australia Re. Application No. 2012241091.
Requisition—Sequence Listing Dated May 8, 2013 From the Canadian Intellectual Property Office Re. Application No. 2,753,616.
Kikuchi et al. "Oryza Saliva Japonica Group cDNA Clone: J023131O04, Full Insert Sequence", GenBank Database Accession No. AK072531, Jul. 2, 2013.

* cited by examiner

POLYNUCLEOTIDES, POLYPEPTIDES AND METHODS FOR INCREASING OIL CONTENT, GROWTH RATE AND BIOMASS OF PLANTS

RELATED APPLICATIONS

This Application is a National Phase of PCT Patent Application No. PCT/IL2008/000489 having International filing date of Apr. 9, 2008, which claims the benefit of U.S. Provisional Patent Application No. 60/907,568 filed on Apr. 9, 2007. The contents of the above Applications are all incorporated herein by reference.

FIELD AND BACKGROUND OF THE INVENTION

The present invention, in some embodiments thereof, relates to polypeptides, polynucleotides encoding same, transgenic plants expressing same and methods of producing and using same, and, more particularly, but not exclusively, to methods of increasing oil content, seed yield, growth rate, biomass and/or yield of a plant.

Vegetable or seed oils are the major source of energy and nutrition in human and animal diet. They are also used for the production of industrial products, such as paints, inks and lubricants. In addition, plant oils represent renewable sources of long-chain hydrocarbons which can be used as fuel. Since the currently used fossil fuels are finite resources and are gradually being depleted, fast growing biomass crops may be used as alternative fuels or for energy feedstocks and may reduce the dependence on fossil energy supplies. However, the major bottleneck for increasing the consumption of plant oils as bio-fuel is the oil price, which is still higher than fossil fuel [Hypertext Transfer Protocol://World Wide Web (dot) eia (dot) doe (dot) gov/oiaf/analysispaper/biodiesel/; Hypertext Transfer Protocol://World Wide Web (dot) njbiz (dot)com/weekly_article.asp?aID=19755147 (dot) 6122555 (dot) 957931 (dot) 7393254 (dot) 4337383 (dot) 561&aID2=73678]. In addition, the production rate of plant oil is limited by the availability of agricultural land and water. Thus, increasing plant oil yields from the same growing area can effectively overcome the shortage in production space and can decrease vegetable oil prices at the same time.

Studies aiming at increasing plant oil yields focus on the identification of genes involved in oil metabolism as well as in genes capable of increasing plant and seed yields in transgenic plants.

Genes known to be involved in increasing plant oil yields include those participating in fatty acid synthesis or sequestering such as desaturase [e.g., DELTA6, DELTA12 or acyl-ACP (Ssi2; *Arabidopsis* Information Resource (TAIR; Hypertext Transfer Protocol://World Wide Web (dot) *arabidopsis* (dot) org/), TAIR No. AT2G43710)], OleosinA (TAIR No. AT3G01570) or FAD3 (TAIR No. AT2G29980), and various transcription factors and activators such as Lec1 [TAIR No. AT1G21970, Lotan et al. 1998. *Cell.* 26; 93(7): 1195-205], Lec2 [TAIR No. AT1G28300, Santos Mendoza et al. 2005, FEBS Lett. 579(21):4666-70], Fus3 (TAIR No. AT3G26790), ABI3 [TAIR No. AT3G24650, Lara et al. 2003. J Biol Chem. 278(23): 21003-11] and Wri1 [TAIR No. AT3G54320, Cernac and Benning, 2004. Plant J. 40(4): 575-85].

Zabrouskov V., et al., 2002 (Physiol Plant. 116:172-185) demonstrated that upregulation of endoplasmic reticulum (FAD3) and plastidal (FAD7) fatty acid desaturases in potato increases the total lipid fraction in transgenic clones.

Wang H W et al., 2007 (Plant J. 52:716-29. Epub 2007 Sep. 18) found that transgenic plant seeds over-expressing the GmDof4 and GmDof11 transcription factors exhibit increased content of total fatty acids and lipids.

Vigeolas H, et al. [Plant Biotechnol J. 2007, 5(3):431-41] and U.S. Pat. Appl. No. 20060168684 disclose increased seed oil content in oil-seed rape (*Brassica napus* L.) by over-expression of a yeast glycerol-3-phosphate dehydrogenase under the control of a seed-specific promoter.

Katavic V, et al., 2000 (Biochem Soc Trans. 28:935-7) describe the use of the *Arabidopsis* FAE1 and yeast SLC1-1 genes for improvements in erucic acid and oil content in rapeseed.

U.S. Pat. Appl. No. 20080076179 discloses an isolated moss nucleic acid encoding a lipid metabolism protein (LMP) and transgenic plants expressing same with increased lipid levels.

U.S. Pat. Appl. No. 20060206961 discloses a method of increasing oil content in plants (e.g., in plant seeds), by expressing in the plant the Ypr140w polypeptide.

U.S. Pat. Appl. No. 20060174373 discloses a method of increasing oil content in plants by expressing a nucleic acid encoding a triacylglycerols (TAG) synthesis enhancing protein (TEP) in the plant.

U.S. Pat. Appl. Nos. 20070169219, 20070006345, 20070006346 and 20060195943, disclose transgenic plants with improved nitrogen use efficiency which can be used for the conversion into fuel or chemical feedstocks.

SUMMARY OF THE INVENTION

According to an aspect of some embodiments of the present invention there is provided a method of increasing oil content, growth rate, biomass, yield and/or vigor of a plant, comprising introducing into the plant an exogenous polynucleotide encoding a polypeptide comprising an amino acid sequence at least 90% homologous to the amino acid sequence selected from the group consisting of SEQ ID NOs: 199, 166-198, 200-221, 229-307, 311-330, 351-353, 355-361, 363-364, 366-368, 218, 222-228, 308-310, 350, 354, 362, 365, 523-649, 786-920, 1047 and 1048, thereby increasing the oil content, growth rate, biomass, yield and/or vigor of the plant.

According to an aspect of some embodiments of the present invention there is provided a method of producing oil, comprising: (a) providing the plant according to the method of the invention, and (b) extracting the oil from the plant; thereby producing the oil.

According to an aspect of some embodiments of the present invention there is provided an isolated polynucleotide comprising a nucleic acid sequence at least 90% identical to SEQ ID NOs: 34, 1-33, 35-52, 54-56, 64-165, 332-334, 336-342, 344-345, 347-349, 53, 57-63, 143-145, 331, 335, 343, 346, 369-522, 650-785, 1016-1046.

According to an aspect of some embodiments of the present invention there is provided a nucleic acid construct, comprising the isolated polynucleotide of the invention and a promoter for directing transcription of the nucleic acid sequence.

According to an aspect of some embodiments of the present invention there is provided an isolated polypeptide, comprising an amino acid sequence at least 90% homologous to SEQ ID NO: 199, 166-198, 200-221, 229-307, 311-330, 351-353, 355-361, 363-364, 366-368, 218, 222-228, 308-310, 350, 354, 362, 365, 523-649, 786-920, 1047 and 1048.

According to an aspect of some embodiments of the present invention there is provided a plant cell exogenously expressing the polypeptide of the invention.

According to an aspect of some embodiments of the present invention there is provided a plant cell exogenously expressing the polynucleotide of the invention.

According to some embodiments of the invention, the polynucleotide comprises a nucleic acid sequence selected from the group consisting of SEQ ID NOs: 34, 1-33, 35-52, 54-56, 64-165, 332-334, 336-342, 344-345, 347-349, 53, 57-63, 143-145, 331, 335, 343, 346, 369-522, 650-785, 1016-1046.

According to some embodiments of the invention, the amino acid sequence is selected from the group consisting of SEQ ID NOs: 199, 166-198, 200-221, 229-307, 311-330, 351-353, 355-361, 363-364, 366-368, 218, 222-228, 308-310, 350, 354, 362, 365, 523-649, 786-920, 1047 and 1048.

According to some embodiments of the invention, the polynucleotide is selected from the group consisting of SEQ ID NOs: 34, 1-33, 35-52, 54-56, 64-165, 332-334, 336-342, 344-345, 347-349, 53, 57-63, 143-145, 331, 335, 343, 346, 369-522, 650-785, 1016-1046.

According to some embodiments of the invention, the polypeptide is selected from the group consisting of SEQ ID NOs: 199, 166-198, 200-221, 229-307, 311-330, 351-353, 355-361, 363-364, 366-368, 218, 222-228, 308-310, 350, 354, 362, 365, 523-649, 786-920, 1047 and 1048.

According to some embodiments of the invention, the oil comprises a seed oil.

According to some embodiments of the invention, the oil comprises a vegetative portion oil.

According to some embodiments of the invention, the plant cell forms a part of a plant.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings.

DESCRIPTION OF SPECIFIC EMBODIMENTS OF THE INVENTION

The present invention, in some embodiments thereof, relates to isolated polypeptides and polynucleotides encoding same, and more particularly, but not exclusively, to methods of using same for increasing oil content, growth rate, yield, biomass and/or vigor of a plant.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

While reducing the present invention to practice, the present inventors have identified novel polypeptides and polynucleotides which can be used to increase oil content, seed yield, growth rate, biomass, yield and/or vigor of a plant.

Figure 3:
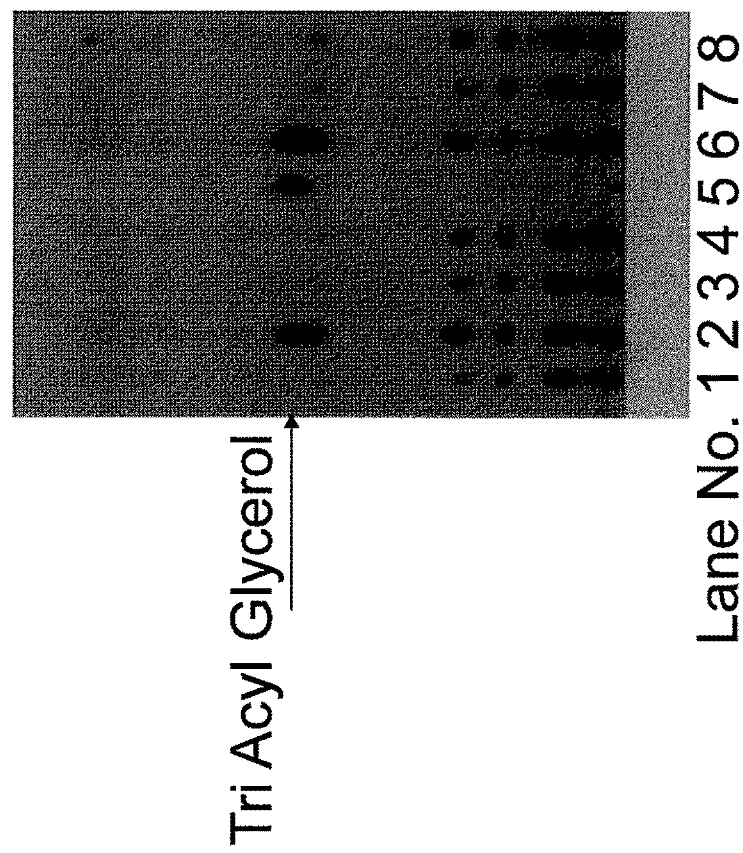
FIG. 3 is an image depicting iodine vapor staining of lipids isolated from the transgenic plants expressing the genes listed in Table 56, Example 7 of the Examples section which follows. The arrow points at the tri acyl glycerol bands.

Thus, as shown in the Examples section which follows, the present inventors have employed a bioinformatics approach which compares the expression pattern of *Arabidopsis*-derived genes in 79 tissues or developmental stages to that of the oil hook genes (OHGs) known to play a role in embryogenesis, seed development and oil synthesis and accumulation, and genes exhibiting a significant correlation were identified (Table 1, Example 1). In addition, using an oligonucleotide micro-array, the present inventors determined the expression profile of identified genes in tissues and developmental stages of various *Arabidopsis* ecotypes (Table 3; Example 2) and correlated the expression profile to selected yield or vigor related parameters (Tables 4, 5 and 6; Example 2). Genes exhibiting a significant correlation between the expression profile and the yield or vigor parameters of the ecotypes were identified (Table 7; Example 2). Of them, several genes were found to modulate seed yield (Table 8), oil yield (Table 9), growth rate (Table 10), organ shape/size/length (Table 11), harvest index (Table 12), oil content per seed (Table 13), plant dry matter (Table 14) and seed number per silique (Table 15). Additional genes which are predicted to increase oil content, seed yield, growth rate, yield and/or biomass of a plant were identified using bioinformatics tools (Table 2, Example 1). In addition, polypeptides and polynucleotides encoding same which are homologous to the predicted polypeptides of Tables 1 and 2 were also identified (Table 18, Example 5). Furthermore, as described in Examples 3, 4 and 6 of the Examples section which follows, transgenic plants expressing the identified polynucleotides exhibit increased seed yield, oil yield, dry matter, harvest index, growth rate, rosette area, oil percentage in seed and weight of 1000 seeds (Tables 19-55; Example 6). In addition, transgenic plants expressing the polynucleotides of the invention exhibited increased oil content as compared to control plants (FIG. 3, Example 7). Altogether, these results suggest the use of the novel polynucleotides and polypeptides of the invention for increasing oil content, yield (including seed yield), growth rate, biomass, and/or vigor of a plant.

It should be noted that since oil content is affected by intrinsic oil production, or mass/size of oil producing tissue per plant/per growth period, any gene which affects these aforementioned processes is contemplated in accordance with the teachings of the present invention.

Thus, according to one aspect of the invention there is provided a method of increasing oil content, yield, growth rate, biomass and/or vigor of a plant. The method is effected by introducing into the plant an exogenous polynucleotide encoding a polypeptide comprising an amino acid sequence at least 90% homologous to the amino acid sequence selected from the group consisting of SEQ ID NOs:166-221, 229-307, 311-330, 351-353, 355-361, 363-364, 366-368, 218, 222-228, 308-310, 350, 354, 362, 365, 523-649, 786-920, 1047 and 1048.

The phrase "oil content" as used herein refers to the amount of lipids in a given plant organ, either the seeds (seed oil content) or the vegetative portion of the plant (vegetative oil content) and typically expressed as percentage of dry weight (10% humidity of seeds) or wet weight (for vegetative portion).

As mentioned, in one embodiment, increase in oil content of the plant can be achieved by increasing the size/mass of a plant's tissue(s) which comprise oil per growth period. Thus, increased oil content of a plant can be achieved by increasing the yield, growth rate, biomass and vigor of the plant.

As used herein the phrase "plant yield" refers to the amount (as determined by weight/size) or quantity (numbers) of tissue (e.g., seed, referred to "seed yield" and vegetative portion) produced per plant or per growing season. Hence increased yield could affect the economic benefit one can obtain from the plant in a certain growing area and/or growing time.

As used herein the phrase "plant biomass" refers to the amount (measured in grams of air-dry tissue) of a tissue produced from the plant in a growing season, which could also determine or affect the plant yield or the yield per growing area.

As used herein the phrase "plant vigor" refers to the amount (measured by weight) of tissue produced by the plant in a given time. Hence increase vigor could determine or affect the plant yield or the yield per growing time or growing area.

As used herein the term "increasing" refers to at least about 2%, at least about 3%, at least about 4%, at least about 5%, at least about 10%, at least about 15%, at least about 20%, at least about 30%, at least about 40%, at least about 50%, at least about 60%, at least about 70%, at least about 80%, increase in plant oil content, seed yield (seed yield per plant and/or seed yield per growing area), plant yield, growth rate, biomass, and/or vigor as compared to a native plant [i.e., a plant not modified with the biomolecules (polynucleotide or polypeptides) of the invention, e.g., a non-transformed plant of the same species which is grown under the same growth conditions).

As used herein, the phrase "exogenous polynucleotide" refers to a heterologous nucleic acid sequence which may not be naturally expressed within the plant or which overexpression in the plant is desired. The exogenous polynucleotide may be introduced into the plant in a stable or transient manner, so as to produce a ribonucleic acid (RNA) molecule and/or a polypeptide molecule. It should be noted that the exogenous polynucleotide may comprise a nucleic acid sequence which is identical or partially homologous to an endogenous nucleic acid sequence of the plant.

According to some embodiments of the invention, the exogenous polynucleotide encodes a polypeptide comprising an amino acid sequence at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or more say 100% homologous to the amino acid sequence selected from the group consisting of SEQ ID NOs:166-221, 229-307, 311-330, 351-353, 355-361, 363-364, 366-368, 218, 222-228, 308-310, 350, 354, 362, 365, 523-649, 786-920, 1047 and 1048.

Homology (e.g., percent homology) can be determined using any homology comparison software, including for example, the BlastP or TBLASTN softwares of the National Center of Biotechnology Information (NCBI) such as by using default parameters, when starting from a polypeptide sequence; or the tBLASTX algorithm (available via the NCBI) such as by using default parameters, which compares the six-frame conceptual translation products of a nucleotide query sequence (both strands) against a protein sequence database.

Homologous sequences include both orthologous and paralogous sequences. The term "paralogous" relates to gene-duplications within the genome of a species leading to paralogous genes. The term "orthologous" relates to homologous genes in different organisms due to ancestral relationship.

One option to identify orthologues in monocot plant species is by performing a reciprocal blast search. This may be done by a first blast involving blasting the sequence-of-interest against any sequence database, such as the publicly available NCBI database which may be found at: Hypertext Transfer Protocol://World Wide Web (dot) ncbi (dot) nlm (dot) nih (dot) gov. If orthologues in rice were sought, the sequence-of-interest would be blasted against, for example, the 28,469 full-length cDNA clones from *Oryza sativa* Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An orthologue is identified when the sequence resulting in the highest score (best hit) in the first blast identifies in the second blast the query sequence (the original sequence-of-interest) as the best hit. Using the same rational a paralogue (homolog to a gene in the same organism) is found. In case of large sequence families, the ClustalW program may be used [Hypertext Transfer Protocol://World Wide Web (dot) ebi (dot) ac (dot) uk/Tools/clustalw2/index (dot) html], followed by a neighbor joining tree (Hypertext Transfer Protocol://en (dot) wikipedia (dot) org/wiki/Neighbor-joining) which helps visualizing the clustering.

According to some embodiments of the invention, the exogenous polynucleotide encodes a polypeptide selected from the group consisting of SEQ ID NOs:166-221, 229-307, 311-330, 351-353, 355-361, 363-364, 366-368, 218, 222-228, 308-310, 350, 354, 362, 365, 523-649, 786-920, 1047 and 1048.

According to some embodiments of the invention the exogenous polynucleotide comprises a nucleic acid sequence which is at least about 60%, at least about 65%, at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, e.g., 100% identical to a nucleic acid sequence selected from the group consisting of SEQ ID NOs: 1-52, 54-56, 64-165, 332-334, 336-342, 344-345, 347-349, 53, 57-63, 143-145, 331, 335, 343, 346, 369-522, 650-785, 1016-1046.

Identity (e.g., percent homology) can be determined using any homology comparison software, including for example, the BlastN software of the National Center of Biotechnology Information (NCBI) such as by using default parameters.

According to some embodiments of the invention the exogenous polynucleotide is set forth by SEQ ID NOs:1-52, 54-56, 64-165, 332-334, 336-342, 344-345, 347-349, 53, 57-63, 143-145, 331, 335, 343, 346, 369-522, 650-785, 1016-1046.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

Nucleic acid sequences encoding the polypeptides of the present invention may be optimized for expression. Non-limiting examples of optimized nucleic acid sequences are provided in SEQ ID NOs:1040, 1041, 1042, 1043, 1044, 1045, and 1046 which encodes polypeptides comprising the amino acid sequences set forth by SEQ ID NOs: 167, 169, 1047, 181, 185, 189 and 196, respectively. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure, for example as described in Sardana et al. (1996, Plant Cell Reports 15:677-681). In this method, the standard deviation of codon usage, a measure of codon usage bias, may be calculated by first finding the squared proportional deviation of usage of each codon of the native gene relative to that of highly expressed plant genes, followed by a calculation of the average squared deviation. The formula used is: $1\ SDCU=n=1N[(X_n-Y_n)/Y_n]2/N$, where $X_n$ refers to the frequency of usage of codon n in highly expressed plant genes, where $Y_n$ to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

One method of optimizing the nucleic acid sequence in accordance with the preferred codon usage for a particular plant cell type is based on the direct use, without performing any extra statistical calculations, of codon optimization tables such as those provided on-line at the Codon Usage Database through the NIAS (National Institute of Agrobiological Sciences) DNA bank in Japan (http://www.kazusa.or.jp/codon/). The Codon Usage Database contains codon usage tables for a number of different species, with each codon usage table having been statistically determined based on the data present in Genbank.

By using the above Tables to determine the most preferred or most favored codons for each amino acid in a particular species (for example, rice), a naturally-occurring nucleotide sequence encoding a protein of interest can be codon optimized for that particular plant species. This is effected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively effect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application 93/07278.

According to some embodiments of the invention, expression of the polynucleotide of the invention results in downregulation of the expression level or activity of the corresponding endogenous polypeptide (e.g., homologue).

According to some embodiments of the invention, the exogenous polynucleotide is used for co-suppression or sense suppression of an endogenous polypeptide. Thus, introducing the exogenous polynucleotide to the plant cells results in transcription of an RNA molecule (in a sense direction with respect to the corresponding endogenous gene) which suppresses translation of the corresponding endogenous RNA molecule, such as described in U.S. Pat. No. 5,231,020 to Jorgensen, which is fully incorporated herein by reference. For co-suppression, the exogenous polynucleotide does not require the entire nucleic acid sequence of the corresponding endogenous gene, nor does it require that the introduced sequence be exactly identical to the endogenous gene. However, as with antisense suppression, the suppressive efficiency is enhanced as specificity of hybridization is increased, e.g., as the introduced sequence is lengthened, and/or as the sequence similarity between the introduced sequence and the endogenous gene is increased. For further details see U.S. Pat. Appl. No. 20050172364 which is fully incorporated herein by reference.

According to some embodiments of the invention, the exogenous polynucleotide comprises an untranslatable nucleic acid sequence, e.g., a sequence comprising one or more pre-mature stop codons, or nonsense mutations, such as described in U.S. Pat. No. 5,583,021.

Thus, the invention encompasses isolated polynucleotides described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

As mentioned, the present inventors have uncovered previously uncharacterized polypeptides.

Thus, the invention provides an isolated polypeptide having an amino acid sequence at least about 70%, at least about 75%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99%, or more say 100% homologous to an amino acid sequence selected from the group consisting of SEQ ID NOs: 166-221, 229-307, 311-330, 351-353, 355-361, 363-364, 366-368, 218, 222-228, 308-310, 350, 354, 362, 365, 523-649, 786-920, 1047 and 1048.

According to some embodiments of the invention, there is provided an exogenous polypeptide selected from the group consisting of SEQ ID NOs:166-221, 229-307, 311-330, 351-353, 355-361, 363-364, 366-368, 218, 222-228, 308-310, 350, 354, 362, 365, 523-649, 786-920, 1047 and 1048.

The invention also encompasses fragments of the above described polypeptides and polypeptides having mutations, such as deletions, insertions or substitutions of one or more amino acids, either naturally occurring or man induced, either randomly or in a targeted fashion.

The term "plant" as used herein encompasses whole plants, ancestors and progeny of the plants and plant parts, including seeds, shoots, stems, roots (including tubers), and plant cells, tissues and organs. The plant may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Dibeteropogon amplectens, Dioclea* spp, *Dolichos* spp., *Dorycnium rectum, Echinochloa pyramidalis, Ehraffia* spp., *Eleusine coracana, Eragrestis* spp., *Erythrina* spp., *Eucalypfus* spp., *Euclea schimperi, Eulalia vi/losa, Pagopyrum* spp., *Feijoa sellowlana, Fragaria* spp., *Flemingia* spp, *Freycinetia banksli, Geranium thunbergii, GinAgo biloba, Glycine javanica, Gliricidia* spp, *Gossypium hirsutum, Grevillea* spp., *Guibourtia coleosperma, Hedysarum* spp., *Hemaffhia altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespediza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria, Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi spp, Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays*, amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barely, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively algae and other non-Viridiplantae can be used for the methods of the present invention.

According to some embodiments of the invention, the oil producing plant can be oilseed crops, soybeans, sunflower, *Brassica napus, Brassica Juncea*, zea maize, cotton, olive (*Olea europaea*), flax, *Brassica nigra, Jatropha curcas*, and Castorbean (*Ricinus communis*).

Introducing the exogenous polynucleotide of the invention into the plant can be effected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is effected by introducing to the plant cell a nucleic acid construct which includes the exogenous polynucleotide of some embodiments of the invention and at least one promoter capable of directing transcription of the exogenous polynucleotide in the plant cell. Further details of suitable transformation approaches are provided hereinbelow.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

Any suitable promoter sequence can be used by the nucleic acid construct of the present invention. According to some embodiments of the invention, the promoter is a constitutive promoter, a tissue-specific, or a developmental or embryonic-specific promoter.

Suitable constitutive promoters include, for example, CaMV 35S promoter (SEQ ID NO:921; Odell et al., Nature 313:810-812, 1985); *Arabidopsis* At6669 promoter (SEQ ID NO:1015; see PCT Publication No. WO2004/104162); maize Ubi 1 (Christensen et al., Plant Sol. Biol. 18:675-689, 1992); rice actin (McElroy et al., Plant Cell 2:163-171, 1990); pEMU (Last et al., Theor. Appl. Genet. 81:581-588, 1991); CaMV 19S (Nilsson et al., Physiol. Plant 100:456-462, 1997); GOS2 (de Pater et al, Plant J November; 2(6):837-44, 1992); Rice cyclophilin (Bucholz et al, Plant Mol. Biol. 25(5):837-43, 1994); Maize H3 histone (Lepetit et al, Mol. Gen. Genet. 231: 276-285, 1992); Actin 2 (An et al, Plant J. 10(1); 107-121, 1996) and Synthetic Super MAS (Ni et al., The Plant Journal 7: 661-76, 1995). Other constitutive promoters include those in U.S. Pat. Nos. 5,659,026, 5,608,149; 5,608,144; 5,604,121; 5,569,597: 5,466,785; 5,399,680; 5,268,463; and 5,608,142.

Suitable tissue-specific promoters include, but not limited to, seed-preferred promoters [e.g., from seed specific genes (Simon, et al., Plant Mol. Biol. 5. 191, 1985; Scofield, et al., J. Biol. Chem. 262: 12202, 1987; Baszczynski, et al., Plant Mol. Biol. 14: 633, 1990), Brazil Nut albumin (Pearson' et al., Plant Mol. Biol. 18: 235-245, 1992), legumin (Ellis, et al. Plant Mol. Biol. 10: 203-214, 1988), Glutelin (rice) (Takaiwa, et al., Mol. Gen. Genet. 208: 15-22, 1986; Takaiwa, et al., FEBS Letts. 221: 43-47, 1987), Zein (Matzke et al Plant Mol Biol, 143: 323-32 1990), napA (Stalberg, et al, Planta 199: 515-519, 1996), Wheat SPA (Albanietal, Plant Cell, 9: 171-184, 1997), sunflower oleosin (Cummins, et al., Plant Mol. Biol. 19: 873-876, 1992)], leaf-specific promoters [such as described, for example, by Yamamoto et al., Plant J. 12:255-265, 1997; Kwon et al., Plant Physiol. 105:357-67, 1994; Yamamoto et al., Plant Cell Physiol. 35:773-778, 1994; Gotor et al., Plant J. 3:509-18, 1993; Orozco et al., Plant Mol. Biol. 23:1129-1138, 1993; and Matsuoka et al., Proc. Natl. Acad. Sci. USA 90:9586-9590, 1993], endosperm specific promoters [e.g., wheat LMW and HMW, glutenin-1 (Mol Gen Genet. 216:81-90, 1989; NAR 17:461-2), wheat a, b and g gliadins (EMBO3:1409-15, 1984), Barley ltrl promoter, barley B1, C, D hordein (Theor Appl Gen 98:1253-62, 1999; Plant J 4:343-55, 1993; Mol Gen Genet. 250:750-60, 1996), Barley DOF (Mena et al, The Plant Journal, 116(1): 53-62, 1998), Biz2 (EP99106056.7), Synthetic promoter (Vicente-Carbajosa et al., Plant J. 13: 629-640, 1998), rice prolamin NRP33, rice-globulin Glb-1 (Wu et al, Plant Cell Physiology 39(8) 885-889, 1998), rice alpha-globulin REB/OHP-1 (Nakase et al. Plant Mol. Biol. 33: 513-S22, 1997), rice ADP-glucose PP (Trans Res 6:157-68, 1997), maize ESR gene family (Plant J 12:235-46, 1997), sorgum gamma-kafirin (PMB 32:1029-35, 1996)], embryo specific promoters [e.g., rice OSH1 (Sato et al, Proc. Natl. Acad. Sci. USA, 93: 8117-8122), KNOX (Postma-Haarsma et al, Plant Mol. Biol. 39:257-71, 1999), rice oleosin (Wu et at, J. Biochem., 123:386, 1998)], and flower-specific promoters [e.g., AtPRP4, chalene synthase (chsA) (Van der Meer, et al., Plant Mol. Biol. 15, 95-109, 1990), LAT52 (Twell et al Mol. Gen. Genet. 217:240-245; 1989), apetala-3].

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu Rev. Plant. Physiol., Plant. Mol. Biol. (1991) 42:205-225; Shimamoto et al., Nature (1989) 338:274-276).

The principle methods of causing stable integration of exogenous DNA into plant genomic DNA include two main approaches:

(i) *Agrobacterium*-mediated gene transfer: Klee et al. (1987) Annu Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S, and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the *Agrobacterium* delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the *Agrobacterium* delivery system in combination with vacuum infiltration. The *Agrobacterium* system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plants are generated by transient transformation of leaf cells, meristematic cells or the whole plant.

Transient transformation can be effected by any of the direct DNA transfer methods described above or by viral infection using modified plant viruses.

Viruses that have been shown to be useful for the transformation of plant hosts include CaMV, TMV and BV. Transformation of plants using plant viruses is described in U.S. Pat. No. 4,855,237 (BGV), EP-A 67,553 (TMV), Japanese Published Application No. 63-14693 (TMV), EPA 194,809 (BV), EPA 278,667 (BV); and Gluzman, Y. et al., Communications in Molecular Biology: Viral Vectors, Cold Spring Harbor Laboratory, New York, pp. 172-189 (1988). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be effected by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-on et al. (1992), Atreya et al. (1992) and Huet et al. (1994).

Suitable virus strains can be obtained from available sources such as, for example, the American Type culture Collection (ATCC) or by isolation from infected plants. Isolation of viruses from infected plant tissues can be effected by techniques well known in the art such as described, for example by Foster and Tatlor, Eds. "Plant Virology Protocols From Virus Isolation to Transgenic Resistance (Methods in Molecular Biology (Humana Pr), Vol 81)", Humana Press, 1998. Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., Virology (1989) 172:285-292; Takamatsu et al. EMBO J. (1987) 6:307-311; French et al. Science (1986) 231:1294-1297; and Takamatsu et al. FEBS Letters (1990) 269:73-76.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

Construction of plant RNA viruses for the introduction and expression in plants of non-viral exogenous polynucleotide sequences such as those included in the construct of the present invention is demonstrated by the above references as well as in U.S. Pat. No. 5,316,931.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found in Foster and Taylor, eds. "Plant Virology Protocols: From Virus Isolation to Transgenic Resistance (Methods in Molecular Biology (Humana Pr), Vol 81)", Humana Press, 1998; Maramorosh and Koprowski, eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily effected by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

Since increasing of the oil content, yield, biomass, growth rate and/or vigor in plants can involve multiple genes acting additively or in synergy (see, for example, in Quesda et al., Plant Physiol. 130:951-063, 2002), the invention also envisages expressing a plurality of exogenous polynucleotides in a single host plant to thereby achieve superior increase of oil content, yield, biomass, growth rate and/or vigor in plants.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messager RNA including all the different exogenous polynucleotide sequences. To enable co-translation of the different polypeptides encoded by the polycistronic messager RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides, can be regenerated into a mature plant, using the methods described hereinabove.

Alternatively, expressing a plurality of exogenous polynucleotides in a single host plant can be effected by introducing different nucleic acid constructs, including different exogenous polynucleotides into a plurality of plants. The regenerated transformed plants can then be cross-bred and resultant progeny selected for superior oil content, growth rate, biomass, yield and/or vigor, using conventional plant breeding techniques.

Thus, the invention encompasses plants exogenously expressing (as described above) the polynucleotide(s) and/or polypeptide(s) of the invention. Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked ImmunoSorbent Assay (ELISA), radio-immuno-assays (RIA), immunohistochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The polynucleotides and polypeptides described hereinabove can be used in a wide range of economical plants, in a safe and cost effective manner.

The effect of the transgene (the exogenous polynucleotide encoding the polypeptide) on oil content, plant yield, seed yield, biomass, growth rate and/or vigor can be determined using known methods.

The oil content of a plant can be determined by extraction of the oil from the seed or the vegetative portion of the plant. Briefly, lipids (oil) can be removed from the plant (e.g., seed) by grinding the plant tissue in the presence of specific solvents (e.g., hexane or petroleum ether) and extracting the oil in a continuous extractor. Indirect oil content analysis can be carried out using various known methods such as Nuclear Magnetic Resonance (NMR) Spectroscopy, which measures the resonance energy absorbed by hydrogen atoms in the liquid state of the sample [See for example, Conway T F. and Earle F R., 1963, Journal of the American Oil Chemists' Society; Springer Berlin/Heidelberg, ISSN: 0003-021X (Print) 1558-9331 (Online)]; the Near Infrared (NI) Spectroscopy, which utilizes the absorption of near infrared energy (1100-2500 nm) by the sample; and a method described in WO/2001/023884, which is based on extracting oil a solvent, evaporating the solvent in a gas stream which forms oil particles, and directing a light into the gas stream and oil particles which forms a detectable reflected light. Another method of determining oil content is described in Example 7 of the Examples section which follows.

The plant vigor can be calculated by the increase in growth parameters such as leaf area, rosette diameter, plant fresh weight and the like per time.

The growth rate can be measured using digital analysis of growing plants. For example, images of plants growing in greenhouse on plot basis can be captured every 3 days and the rosette area can be calculated by digital analysis. Rosette area growth is calculated using the difference of rosette area between days of sampling divided by the difference in days between samples.

Measurements of seed yield can be done by collecting the total seeds from 8-16 plants together, weighting them using analytical balance and dividing the total weight by the number of plants. Seed per growing area can be calculated in the same manner while taking into account the growing area given to a single plant. Increase seed yield per growing area could be achieved by increasing seed yield per plant, and/or by increasing number of plants capable of growing in a given area.

Evaluation of the seed yield per plant can be done by measuring the amount (weight or size) or quantity (i.e., number) of dry seeds produced and harvested from 8-16 plants and divided by the number of plants.

Evaluation of growth rate can be done by measuring plant biomass produced, rosette area, leaf size or root length per time (can be measured in $cm^2$ per day of leaf area).

Thus, the present invention is of high agricultural value for promoting the yield of commercially desired crops (e.g., seeds).

Any of the transgenic plants described hereinabove or parts thereof may be processed to produce a feed, meal, protein or oil preparation, such as for ruminant animals.

The transgenic plants described hereinabove, which exhibit an increased oil content can be used to produce plant oil (by extracting the oil from the plant).

The plant oil (including the seed oil and/or the vegetative portion oil) produced according to the method of the invention may be combined with a variety of other ingredients. The specific ingredients included in a product are determined according to the intended use. Exemplary products include animal feed, raw material for chemical modification, biodegradable plastic, blended food product, edible oil, biofuel, cooking oil, lubricant, biodiesel, snack food, cosmetics, and fermentation process raw material. Exemplary products to be incorporated to the plant oil include animal feeds, human food products such as extruded snack foods, breads, as a food binding agent, aquaculture feeds, fermentable mixtures, food supplements, sport drinks, nutritional food bars, multi-vitamin supplements, diet drinks, and cereal foods.

As used herein the term "about" refers to ±10%.

The terms "comprises", "comprising", "includes", "including", "having" and their conjugates mean "including but not limited to".

The term "consisting of means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible sub-ranges as well as individual numerical values within that range. For example, description of a range such as from 1 to 6 should be considered to have specifically disclosed sub-ranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W.H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Gene Identification and Gene Role Prediction Using Bioinformatics Tools

Genes encoding polypeptides, suitable for increasing seed oil and seed yield were identified by in-depth analysis of RNA expression profiles, sequence similarities, gene annotations, biochemical pathways, DNA, ESTs, protein and expression databases deposited in the internet.

Bioinformatics Tools

In-Silico Gene Identification

To identify novel genes which could greatly affect seed oil yield, *Arabidopsis* genes, already found to play key role in embryogenesis, seed development and oil synthesis and accumulation were identified in the literature ('oil hook genes'—OHGs). OHGs number is according to TAIR website [Hypertext Transfer Protocol://World Wide Web (dot) *arabidopsis* (dot) org/] and includes all information on the OHGs. OHGs include wild-type alleles of Ssi2 (AT2G43710), OleosinA (AT3G01570), Lec1 (AT1G21970), Lec2 (AT1G28300), Fus3 (AT3G26790), FAD3 (AT2G29980), ABI3 (AT3G24650) and Wri1 (AT3G54320). Comparison of gene expression profile in 79 different developmental stages of *Arabidopsis* was done on the OHGs genes and all other genes printed on the Nottingham *Arabidopsis* Stock Centre [(NASC), Hypertext Transfer Protocol://affymetrix (dot) arabidopsis (dot) info/)] micro-arrays describing anatomy, development and various stress experiments. Correlation was determined using the Pearson correlation statistic analysis [Hypertext Transfer Protocol://davidmlane (dot) com/hyperstat/A34739 (dot) html].

The criteria used for each of the genes are described in detail in Table 1 below and cover a variety of biological rationales that use various bioinformatics approaches. The genes were selected to cause changes in seed size and/or seed oil yield based on their highest expression correlation (given as Pearson R values between 0.7<R<1) to one or more of the OHGs. The list of genes identified and their correlation (R value) to each of the OHGs are provided in Table 1, hereinbelow.

TABLE 1

Table 1

| Serial No | Nucl. SEQ ID NO: | Prot. SEQ ID NO: | BDL No | TAIR-gene name | R wri1 | R abi3 | R fus3 | R oleosin A | R ssi2 | R fad3 | R lec1 | R lec2 |
|---|---|---|---|---|---|---|---|---|---|---|---|---|
| 1 | 1 | 166 | 3 | AT5G50770 | | 0.891 | 0.986 | 0.897 | 0.791 | 0.882 | | |
| 2 | 2 | 167 | 1 | AT1G65090 | | 0.995 | 0.921 | 0.997 | 0.715 | 0.902 | | |
| 3 | 3 | 168 | 2 | AT1G34580 | | | | | | | 0.955 | 0.915 |
| 4 | 4 | 169 | 4 | AT2G45420 | 0.933 | | 0.893 | 0.713 | 0.74 | 0.716 | 0.759 | 0.76 |
| 5 | 5 | 170 | 5 | AT3G14360 | | 0.969 | 0.96 | 0.97 | 0.731 | 0.914 | | |
| 6 | 6 | 171 | 6 | AT4G10490 | 0.912 | | 0.88 | 0.725 | 0.76 | 0.71 | 0.757 | 0.755 |
| 7 | 7 | 172 | 7 | AT5G51490 | 0.901 | 0.722 | 0.92 | 0.745 | 0.79 | 0.797 | | |
| 8 | 8 | 173 | 8 | AT3G03240 | | 0.947 | 0.982 | 0.956 | 0.775 | 0.912 | | |
| 9 | 9 | 174 | 9 | AT5G24130 | | 0.988 | 0.917 | 0.987 | | 0.91 | | |

TABLE 1-continued

Table 1

| Serial No | Nucl. SEQ ID NO: | Prot. SEQ ID NO: | BDL No | TAIR-gene name | R wri1 | R abi3 | R fus3 | R oleosin A | R ssi2 | R fad3 | R lec1 | R lec2 |
|---|---|---|---|---|---|---|---|---|---|---|---|---|
| 10 | 10 | 175 | 10 | AT5G09640 | 0.719 | 0.905 | 0.98 | 0.91 | 0.8 | 0.908 | | |
| 11 | 11 | 176 | 11 | AT5G12460 | 0.815 | | | | | | 0.969 | 0.911 |
| 12 | 12 | 177 | 12 | AT4G08530 | | | | | | | 0.931 | 0.919 |
| 13 | 13 | 178 | 14 | AT1G53690 | 0.931 | | 0.792 | | 0.74 | | | |
| 14 | 14 | 179 | 15 | AT1G68510 | 0.905 | | | | | | 0.938 | 0.913 |
| 15 | 15 | 180 | 16 | AT5G03800 | 0.8 | 0.878 | 0.966 | 0.894 | 0.797 | 0.882 | | |
| 16 | 16 | 181 | 17 | AT5G36770 | | | | | | | 0.922 | 0.921 |
| 17 | 17 | 182 | 18 | AT5G40420 | | 0.997 | 0.894 | 0.9996 | | 0.886 | | |
| 18 | 18 | 183 | 19 | AT2G02080 | | 0.702 | 0.741 | 0.72 | 0.748 | | | |
| 19 | 19 | 184 | 20a | AT1G47540.1 | | 0.993 | 0.915 | 0.995 | 0.71 | 0.892 | | |
| 20 | 20 | 185 | 20b | AT1G47540.2 | | 0.993 | 0.915 | 0.995 | 0.71 | 0.892 | | |
| 21 | 21 | 186 | 21 | AT3G62730 | | 0.995 | 0.92 | 0.993 | 0.711 | 0.903 | | |
| 22 | 22 | 187 | 22 | AT2G27380 | | 0.995 | 0.873 | 0.997 | | 0.875 | | |
| 23 | 23 | 188 | 23 | AT3G27785 | 0.939 | | | | | | 0.867 | 0.81 |
| 24 | 24 | 189 | 2991 | AT5G15000 | | 0.955 | 0.959 | 0.957 | 0.739 | 0.902 | | |
| 25 | 25 | 190 | 25 | AT3G20910 | | 0.963 | 0.943 | 0.962 | | 0.883 | | |
| 26 | 26 | 191 | 26a | AT1G11170.1 | | 0.926 | 0.981 | 0.929 | 0.765 | 0.894 | | |
| 27 | 27 | 192 | 26b | AT1G11170.2 | | 0.926 | 0.981 | 0.929 | 0.765 | 0.894 | | |
| 28 | 28 | 193 | 27 | AT1G68380 | | 0.97 | 0.965 | 0.977 | 0.77 | 0.92 | | |
| 29 | 29 | 194 | 28 | AT1G09380 | 0.705 | 0.899 | 0.95 | 0.91 | 0.756 | 0.897 | | |
| 30 | 30 | 195 | 29 | AT1G60970 | 0.92 | 0.709 | 0.908 | 0.746 | 0.78 | 0.747 | 0.742 | 0.745 |
| 31 | 31 | 196 | 30 | AT1G72580 | | | | | | | 0.935 | 0.917 |
| 32 | 32 | 197 | 31 | AT2G28490 | | 0.998 | 0.871 | 0.995 | | 0.882 | | |
| 33 | 33 | 198 | 32a | AT2G46960.1 | 0.89 | | | | | | 0.937 | 0.9 |
| 34 | 34 | 199 | 32b | AT2G46960.2 | 0.89 | | | | | | 0.937 | 0.9 |
| 35 | 35 | 200 | 166 | AT1G71691 | 0.938 | | 0.71 | | | | 0.723 | 0.713 |
| 36 | 36 | 201 | 330 | AT1G73220 | | 0.761 | 0.755 | 0.759 | | 0.768 | | |
| 37 | 37 | 202 | 3004 | AT5G01790 | 0.792 | | | | | | 0.899 | 0.85 |
| 38 | 38 | 203 | 333 | AT1G71120 | 0.866 | | | | | | 0.925 | 0.856 |
| 39 | 39 | 204 | 334 | AT5G38170 | 0.937 | | 0.869 | | 0.744 | | 0.81 | 0.793 |
| 40 | 40 | 205 | 335 | AT3G25160 | 0.88 | | 0.874 | | 0.747 | 0.761 | | |
| 41 | 41 | 206 | 336 | AT1G18100 | 0.917 | | 0.851 | | 0.751 | 0.711 | | |
| 42 | 42 | 207 | 337 | AT2G22620 | 0.906 | | | | | | 0.927 | 0.888 |
| 43 | 43 | 208 | 339 | AT3G26480 | | 0.785 | 0.717 | 0.784 | | | | |
| 44 | 44 | 209 | 340 | AT1G64660 | | 0.872 | 0.854 | 0.882 | | 0.808 | | |
| 45 | 45 | 210 | 341 | AT5G52330 | 0.811 | | | | | | 0.796 | 0.774 |
| 46 | 46 | 211 | 341 | AT5G52330 | 0.811 | | | | | | 0.796 | 0.774 |
| 47 | 47 | 212 | 342 | AT1G52670 | 0.802 | | | | | | | |
| 48 | 48 | 213 | 343 | AT5G64080 | | 0.923 | 0.876 | 0.923 | | 0.92 | | |
| 49 | 49 | 214 | 343 | AT5G64080 | | 0.923 | 0.876 | 0.923 | | 0.92 | | |
| 50 | 50 | 215 | 344 | AT2G43060 | 0.726 | | | | | | 0.857 | 0.794 |
| 51 | 51 | 216 | 345 | AT1G27330 | | 0.839 | 0.856 | 0.837 | | 0.814 | | |
| 52 | 52 | 217 | 2999 | AT2G41340 | 0.816 | | 0.745 | | 0.744 | | | |
| 53 | 54 | 219 | 2810 | AT2G13290 | | 0.878 | 0.76 | 0.876 | | 0.74 | | |
| 54 | 55 | 220 | 349 | AT4G33670 | | 0.861 | | 0.855 | | 0.734 | | |
| 55 | 56 | 221 | 350 | AT5G04500 | | 0.899 | 0.702 | 0.894 | | 0.756 | | |
| 56 | 64 | 229 | 358 | AT3G01570 | | 0.996 | 0.904 | 1 | | 0.891 | | |
| 57 | 65 | 230 | 359 | AT2G15010 | | 0.944 | 0.955 | 0.942 | 0.763 | 0.924 | | |
| 58 | 66 | 231 | 362 | AT2G25940 | 0.791 | 0.873 | 0.977 | 0.885 | 0.777 | 0.873 | | |
| 59 | 67 | 232 | 364 | AT1G04660 | 0.94 | | 0.882 | | 0.763 | 0.715 | 0.777 | 0.768 |
| 60 | 68 | 233 | 365 | AT1G05160 | 0.945 | | | | | | 0.857 | 0.814 |
| 61 | 69 | 234 | 2992 | AT1G05280 | 0.939 | | 0.805 | | | | 0.859 | 0.84 |
| 62 | 70 | 235 | 2993 | AT1G19900 | | 0.975 | 0.909 | 0.962 | | 0.898 | | |
| 63 | 71 | 236 | 368 | AT1G23200 | 0.852 | | | | | | 0.957 | 0.906 |
| 64 | 72 | 237 | 369 | AT1G26680 | 0.93 | | | | | | 0.738 | 0.717 |
| 65 | 73 | 238 | 370 | AT1G28590 | 0.937 | | | | | | 0.855 | 0.813 |
| 66 | 74 | 239 | 371 | AT1G48910 | 0.877 | 0.753 | 0.912 | 0.77 | 0.808 | 0.807 | | |
| 67 | 75 | 240 | 2995 | AT1G51000 | 0.906 | | | | | | 0.785 | 0.77 |
| 68 | 76 | 241 | 373 | AT1G62340 | 0.712 | | | | | | 0.978 | 0.903 |
| 69 | 77 | 242 | 374 | AT1G62610 | | 0.946 | 0.909 | 0.938 | | 0.891 | | |
| 70 | 78 | 243 | 374 | AT1G62610 | | 0.946 | 0.909 | 0.938 | | 0.891 | | |
| 71 | 79 | 244 | 374 | AT1G62610 | | 0.946 | 0.909 | 0.938 | | 0.891 | | |
| 72 | 80 | 245 | 375 | AT1G76290 | 0.735 | 0.91 | 0.967 | 0.923 | 0.803 | 0.904 | | |
| 73 | 81 | 246 | 376 | AT1G68470 | 0.917 | | 0.814 | | | | | |
| 74 | 82 | 247 | 377 | AT1G71250 | 0.922 | | | | | | 0.93 | 0.881 |
| 75 | 83 | 248 | 379 | AT3G58200 | 0.719 | 0.897 | 0.973 | 0.907 | 0.771 | 0.914 | | |
| 76 | 84 | 249 | 380 | AT1G78500 | 0.731 | 0.844 | 0.964 | 0.843 | 0.788 | 0.879 | | |
| 77 | 85 | 250 | 381 | AT2G14690 | | | | | | | 0.972 | 0.916 |
| 78 | 86 | 251 | 382 | AT3G63040 | | 0.949 | 0.979 | 0.962 | 0.783 | 0.907 | | |
| 79 | 87 | 252 | 383 | AT2G15325 | | | | | | | 0.978 | 0.929 |
| 80 | 88 | 253 | 384 | AT2G23510 | 0.804 | 0.767 | 0.943 | 0.777 | 0.789 | 0.85 | | |
| 81 | 89 | 254 | 385 | AT2G26070 | 0.927 | | | | | | 0.827 | 0.762 |
| 82 | 90 | 255 | 2997 | AT2G28650 | 0.811 | | 0.711 | | | | 0.953 | 0.939 |

TABLE 1-continued

Table 1

| Serial No | Nucl. SEQ ID NO: | Prot. SEQ ID NO: | BDL No | TAIR-gene name | R wri1 | R abi3 | R fus3 | R oleosin A | R ssi2 | R fad3 | R lec1 | R lec2 |
|---|---|---|---|---|---|---|---|---|---|---|---|---|
| 83 | 91 | 256 | 2998 | AT2G41290 | 0.827 | | 0.869 | | 0.779 | 0.786 | | |
| 84 | 92 | 257 | 389 | AT2G42860 | 0.903 | | 0.829 | | 0.727 | | 0.825 | 0.813 |
| 85 | 93 | 258 | 390 | AT2G47750 | 0.906 | | 0.744 | | | | 0.784 | 0.754 |
| 86 | 94 | 259 | 391 | AT3G03230 | 0.828 | 0.844 | 0.954 | 0.854 | 0.783 | 0.833 | | |
| 87 | 95 | 260 | 392 | AT3G04200 | 0.912 | | 0.827 | | 0.733 | | | |
| 88 | 96 | 261 | 393 | AT3G21840 | 0.702 | | | | | | 0.968 | 0.928 |
| 89 | 97 | 262 | 3000 | AT3G22640 | | 0.995 | 0.855 | 0.991 | | 0.873 | | |
| 90 | 98 | 263 | 395 | AT3G49380 | 0.919 | | 0.724 | | | | 0.843 | 0.784 |
| 91 | 99 | 264 | 3001 | AT4G03050 | 0.93 | | 0.847 | | 0.749 | | | |
| 92 | 100 | 265 | 3001 | AT4G03050 | 0.93 | | 0.847 | | 0.749 | | | |
| 93 | 101 | 266 | 3003 | AT4G19380 | 0.783 | 0.792 | 0.913 | 0.803 | 0.826 | 0.839 | | |
| 94 | 102 | 267 | 398 | AT4G27460 | | 0.992 | 0.896 | 0.985 | | 0.897 | | |
| 95 | 103 | 268 | 399 | AT4G33280 | 0.885 | 0.715 | 0.912 | 0.732 | 0.811 | 0.8 | | |
| 96 | 104 | 269 | 400 | AT4G33600 | 0.917 | | | | | | 0.908 | 0.851 |
| 97 | 105 | 270 | 401 | AT5G07260 | 0.956 | | 0.82 | | 0.73 | | | |
| 98 | 106 | 271 | 3007 | AT5G08460 | 0.955 | | 0.768 | | 0.702 | | 0.757 | 0.747 |
| 99 | 107 | 272 | 403 | AT2G34700 | 0.932 | | 0.903 | | 0.783 | 0.741 | | |
| 100 | 108 | 273 | 404 | AT5G15740 | 0.911 | | 0.712 | | | | 0.883 | 0.818 |
| 101 | 109 | 274 | 405 | AT5G16230 | 0.812 | 0.82 | 0.961 | 0.834 | 0.773 | 0.858 | | |
| 102 | 110 | 275 | 406 | AT5G18290 | 0.905 | | 0.722 | | | | 0.821 | 0.803 |
| 103 | 111 | 276 | 2814 | AT5G25470 | 0.901 | | | | | | 0.748 | 0.711 |
| 104 | 112 | 277 | 408 | AT5G39130 | 0.951 | | 0.726 | | | | 0.769 | 0.75 |
| 105 | 113 | 278 | 409 | AT5G39160 | 0.94 | | 0.729 | | | | 0.829 | 0.789 |
| 106 | 114 | 279 | 409 | AT5G39160 | 0.94 | | 0.729 | | | | 0.829 | 0.789 |
| 107 | 115 | 280 | 410 | AT5G39190 | 0.951 | | 0.795 | | 0.706 | | 0.754 | 0.737 |
| 108 | 116 | 281 | 411 | AT5G44360 | 0.828 | 0.833 | 0.975 | 0.855 | 0.804 | 0.849 | | |
| 109 | 117 | 282 | 412 | AT5G47670 | 0.957 | | | | | | 0.797 | 0.759 |
| 110 | 118 | 283 | 3008 | AT5G49820 | 0.905 | | | | 0.715 | | | |
| 111 | 119 | 284 | 414 | AT5G56300 | 0.936 | | 0.823 | | 0.717 | | 0.712 | |
| 112 | 120 | 285 | 416 | AT5G59170 | | 0.995 | 0.852 | 0.991 | | 0.87 | | |
| 113 | 121 | 286 | 418 | AT1G28640 | | 0.967 | 0.949 | 0.975 | 0.752 | 0.92 | | |
| 114 | 122 | 287 | 419 | AT1G22990 | | 0.789 | 0.889 | 0.794 | | 0.738 | | |
| 115 | 123 | 288 | 2816a | AT1G64110.1 | | 0.883 | | 0.869 | | 0.701 | | |
| 116 | 124 | 289 | 2816b | AT1G64110.2 | | 0.883 | | 0.869 | | 0.701 | | |
| 117 | 125 | 290 | 421 | AT1G04380 | 0.971 | | 0.798 | | 0.717 | | 0.772 | 0.749 |
| 118 | 126 | 291 | 2817 | AT1G08810 | | 0.888 | 0.948 | 0.885 | 0.831 | 0.862 | | |
| 119 | 127 | 292 | 2817 | AT1G08810 | | 0.888 | 0.948 | 0.885 | 0.831 | 0.862 | | |
| 120 | 128 | 293 | 423 | AT1G28170 | | | | | | | 0.962 | 0.903 |
| 121 | 129 | 294 | 424 | AT1G28650 | 0.821 | 0.843 | 0.974 | 0.853 | 0.801 | 0.844 | | |
| 122 | 130 | 295 | 425 | AT3G10590 | | | | | | | 0.969 | 0.944 |
| 123 | 131 | 296 | 426 | AT3G58740 | 0.948 | | 0.842 | | 0.745 | | | |
| 124 | 132 | 297 | 427 | AT4G02360 | | 0.941 | 0.941 | 0.937 | 0.731 | 0.915 | | |
| 125 | 133 | 298 | 428 | AT4G36700 | | 0.965 | 0.967 | 0.976 | 0.768 | 0.899 | | |
| 126 | 134 | 299 | 429 | AT5G07200 | 0.957 | | 0.851 | | 0.753 | | 0.725 | 0.71 |
| 127 | 135 | 300 | 430 | AT5G22810 | 0.958 | | 0.702 | | | | 0.86 | 0.834 |
| 128 | 136 | 301 | 431 | AT5G43860 | | 0.866 | 0.916 | 0.868 | 0.776 | 0.817 | | |
| 129 | 137 | 302 | 432 | AT5G57390 | | 0.989 | 0.914 | 0.987 | 0.713 | 0.916 | | |
| 130 | 138 | 303 | 433 | AT5G62800 | | 0.961 | 0.967 | 0.962 | 0.769 | 0.913 | | |
| 131 | 139 | 304 | 435 | AT5G52500 | | | | | | | 0.956 | 0.876 |
| 132 | 140 | 305 | 436 | AT5G24600 | | 0.956 | 0.902 | 0.954 | | 0.863 | | |
| 133 | 141 | 306 | 2818 | AT2G23550 | 0.829 | | | | | | 0.928 | 0.839 |
| 134 | 142 | 307 | 2818 | AT2G23550 | 0.829 | | | | | | 0.928 | 0.839 |
| 135 | 146 | 311 | 441 | AT5G48100 | 0.737 | 0.923 | 0.95 | 0.944 | 0.761 | 0.864 | | |
| 136 | 147 | 312 | 442 | AT1G14760 | 0.708 | 0.874 | 0.93 | 0.876 | 0.831 | 0.877 | | |
| 137 | 148 | 313 | 443 | AT1G15150 | 0.871 | | | | | | 0.971 | 0.92 |
| 138 | 149 | 314 | 444 | AT1G20500 | 0.92 | | 0.783 | | | | 0.904 | 0.874 |
| 139 | 150 | 315 | 445 | AT1G56170 | 0.966 | | 0.751 | | | | 0.782 | 0.751 |
| 140 | 151 | 316 | 2996 | AT1G62070 | 0.956 | | | | | | 0.847 | 0.797 |
| 141 | 152 | 317 | 447 | AT1G67100 | | 0.967 | 0.969 | 0.973 | 0.761 | 0.914 | | |
| 142 | 153 | 318 | 448 | AT3G21090 | 0.902 | | 0.724 | | | | | |
| 143 | 154 | 319 | 449 | AT3G24250 | 0.826 | | | | | | 0.986 | 0.931 |
| 144 | 155 | 320 | 450 | AT3G50990 | 0.715 | | | | | | 0.982 | 0.914 |
| 145 | 156 | 321 | 451 | AT4G00220 | 0.905 | 0.741 | 0.923 | 0.773 | 0.782 | 0.779 | 0.7 | 0.703 |
| 146 | 157 | 322 | 452 | AT4G10150 | 0.706 | 0.875 | 0.95 | 0.883 | 0.821 | 0.886 | | |
| 147 | 158 | 323 | 3006 | AT5G07190 | | 0.998 | 0.903 | 0.997 | | 0.901 | | |
| 148 | 159 | 324 | 3006 | AT5G07190 | | 0.998 | 0.903 | 0.997 | | 0.901 | | |
| 149 | 160 | 325 | 455 | AT5G10220 | 0.722 | | | | | | 0.984 | 0.917 |
| 150 | 161 | 326 | 456 | AT5G20940 | | 0.969 | 0.901 | 0.961 | | 0.901 | | |
| 151 | 162 | 327 | 457 | AT5G51210 | 0.907 | 0.7 | 0.925 | 0.734 | 0.788 | 0.752 | 0.702 | 0.7 |
| 152 | 163 | 328 | 458 | AT5G55620 | 0.704 | 0.769 | 0.898 | 0.776 | 0.871 | 0.8 | | |
| 153 | 164 | 329 | 459 | AT5G60460 | | 0.987 | 0.931 | 0.988 | | 0.902 | | |
| 154 | 165 | 330 | 460 | AT5G65590 | 0.793 | 0.725 | 0.882 | 0.754 | 0.783 | 0.77 | | |
| 155 | 332 | 351 | 2991 | AT5G15000 | | 0.955 | 0.959 | 0.957 | 0.739 | 0.902 | | |

TABLE 1-continued

Table 1

| Serial No | Nucl. SEQ ID NO: | Prot. SEQ ID NO: | BDL No | TAIR-gene name | R wri1 | R abi3 | R fus3 | R oleosin A | R ssi2 | R fad3 | R lec1 | R lec2 |
|---|---|---|---|---|---|---|---|---|---|---|---|---|
| 156 | 333 | 352 | 2992 | AT1G05280 | 0.939 | | 0.805 | | | | 0.859 | 0.84 |
| 157 | 334 | 353 | 2993 | AT1G19900 | | 0.975 | 0.909 | 0.962 | | 0.898 | | |
| 158 | 336 | 355 | 2995 | AT1G51000 | 0.906 | | | | | | 0.785 | 0.77 |
| 159 | 337 | 356 | 2996 | AT1G62070 | 0.956 | | | | | | 0.847 | 0.797 |
| 160 | 338 | 357 | 2997 | AT2G28650 | 0.811 | | 0.711 | | | | 0.953 | 0.939 |
| 161 | 339 | 358 | 2998 | AT2G41290 | 0.827 | | 0.869 | | 0.779 | 0.786 | | |
| 162 | 340 | 359 | 2999 | AT2G41340 | 0.816 | | 0.745 | | 0.744 | | | |
| 163 | 341 | 360 | 3000 | AT3G22640 | | 0.995 | 0.855 | 0.991 | | 0.873 | | |
| 164 | 342 | 361 | 3001 | AT4G03050 | 0.93 | | 0.847 | | 0.749 | | | |
| 165 | 344 | 363 | 3003 | AT4G19380 | 0.783 | 0.792 | 0.913 | 0.803 | 0.826 | 0.839 | | |
| 166 | 345 | 364 | 3004 | AT5G01790 | 0.792 | | | | | | 0.899 | 0.85 |
| 167 | 347 | 366 | 3006 | AT5G07190 | | 0.998 | 0.903 | 0.997 | | 0.901 | | |
| 168 | 348 | 367 | 3007 | AT5G08460 | 0.955 | | 0.768 | | 0.702 | | 0.757 | 0.747 |
| 169 | 349 | 368 | 3008 | AT5G49820 | 0.905 | | | | 0.715 | | | |

Additional genes which are predicted to affect seed oil synthesis and which were identified using bioinformatics tools are provided in Table 2, below.

TABLE 2

Table 2

| Serial No | Polynucleotide SEQ ID NO: | Polypeptide SEQ ID NO: | BDL No. | TAIR-gene name |
|---|---|---|---|---|
| 1 | 53 | 218 | 3005 | AT5G03450.1 |
| 2 | 57 | 222 | 351 | AT1G27120.1 |
| 3 | 58 | 223 | 352 | AT5G01820.1 |
| 4 | 59 | 224 | 353 | AT2G32780.1 |
| 5 | 60 | 225 | 354 | AT3G16490.1 |
| 6 | 61 | 226 | 355 | AT5G23050.1 |
| 7 | 62 | 227 | 3002 | AT4G16050.1 |
| 8 | 63 | 228 | 2994 | AT1G44760.1 |
| 9 | 143 | 308 | 438 | AT1G72040 |
| 10 | 144 | 309 | 439 | AT1G53070 |
| 11 | 145 | 310 | 440 | AT1G50510 |
| 12 | 331 | 350 | 2990 | AT5G14995 |
| 13 | 335 | 354 | 2994 | AT1G44760 |
| 14 | 343 | 362 | 3002 | AT4G16050 |
| 15 | 346 | 365 | 3005 | AT5G03450 |

Example 2

Production of *Arabidopsis* Transcriptom and High Throughput Correlation Analysis Using 44K *Arabidopsis* Full Genome Oligonucleotide Micro-Array In order to produce a high throughput correlation analysis, the present inventors utilized an *Arabidopsis thaliana* oligonucleotide micro-array, produced by Agilent Technologies [Hypertext Transfer Protocol://World Wide Web (dot) chem. (dot) agilent (dot) com/Scripts/PDS (dot) asp?1 Page=50879]. The array oligonucleotide represents about 40,000 *A. thaliana* genes and transcripts designed based on data from the TIGR ATH1 v.5 database and *Arabidopsis* MPSS (University of Delaware) databases. In order to define correlations between the levels of RNA expression and yield components or vigor related parameters, various plant characteristics of 15 different *Arabidopsis* ecotypes were analyzed. Among them, nine ecotypes encompassing the observed variance were selected for RNA expression analysis. The correlation between the RNA levels and the characterized parameters was analyzed using Pearson correlation test [Hypertext Transfer Protocol://World Wide Web (dot) davidmlane (dot) com/hyperstat/A34739 (dot) html].

Experimental Procedures

RNA Extraction

Five tissues at different developmental stages [root, leaf, flower at anthesis, seed at 5 days after flowering (DAF) and seed at 12 DAF], representing different plant characteristics, were sampled and RNA was extracted using TRIzol Reagent from Invitrogen [Hypertext Transfer Protocol://World Wide Web (dot) invitrogen (dot) com/content (dot) cfm?pageid=469]. For convenience, each micro-array expression information tissue type has received a Set ID as summarized in Table 3 below.

TABLE 3

Table 3
*Arabidopsis* transcriptom experimental sets

| Expression Set | Set ID |
|---|---|
| Root | A |
| Leaf | B |
| Flower | C |
| Seed 5 DAF | D |
| Seed 12 DAF | E |

Approximately 30-50 mg of tissue was taken from samples. The weighed tissues were ground using pestle and mortar in liquid nitrogen and resuspended in 500 μl of TRIzol Reagent. To the homogenized lysate, 100 μl of chloroform was added followed by precipitation using isopropanol and two washes with 75% ethanol. The RNA was eluted in 30 μl of RNase-free water. RNA samples were cleaned up using Qiagen's RNeasy minikit clean-up protocol as per the manufacturer's protocol.

Yield Component and Vigor Related Parameters Assessment

8 *Arabidopsis* ecotypes in 5 repetitive blocks (named A, B, C, D and E), each containing 20 plants per plot were grown at control conditions greenhouse 22° C., 20:20:20 (weight ratios) N:P:K [nitrogen (N), phosphorus (P) and potassium (K)] fertilizer was added. During this time data was collected documented and analyzed. Additional data was collected through the seedling stage of plants grown at tissue culture in vertical grown transparent agar plates. Data parameters collected are summarized in Table 4, below.

TABLE 4

Table 4
*Arabidopsis* correlated parameters (vectors)

| Correlated parameter with | Correlation Id |
|---|---|
| Root length day 13 (cm) | 1 |
| Root length day 7 (cm) | 2 |
| Relative root growth (cm/day) day 13 | 3 |
| Fresh weight per plant (gr) at bolting stage | 4 |
| Dry matter per plant (gr) | 5 |
| Vegetative growth rate ($cm^2$/day) till 8 true leaves | 6 |
| Blade circularity | 7 |
| Lamina width (cm) | 8 |
| Lamina length (cm) | 9 |
| Total leaf area per plant (cm) | 10 |
| 1000 Seed weight (gr) | 11 |
| Oil % per seed | 12 |
| Seeds per silique | 13 |
| Silique length (cm) | 14 |
| Seed yield per plant (gr) | 15 |
| Oil yield per plant (mg) | 16 |
| Harvest Index | 17 |
| Leaf width/length | 18 |

Most of chosen parameters were analyzed by digital imaging.

Digital Imaging

A laboratory image acquisition system, which consists of a digital reflex camera (Canon EOS 300D) attached with a 55 mm focal length lens (Canon EF-S series), mounted on a reproduction device (Kaiser R S), which included 4 light units (4×150 Watts light bulb) and located in a darkroom, was used for capturing images of plantlets sawn in square agar plates.

The image capturing process was repeated every 2 days starting at day 7 till day 14. The same camera attached with a 24 mm focal length lens (Canon EF series), placed in a custom made iron mount, was used for capturing images of larger plants sawn in white tubs in an environmental controlled greenhouse (as seen on FIG. 2*b*). The white tubs were square shape with measurements of 36×26.2 cm and 7.5 cm deep. During the capture process, the tubs were placed beneath the iron mount, while avoiding direct sun light and casting of shadows. This process was repeated every 3-4 days for up to 30 days.

An image analysis system was used, which consists of a personal desktop computer (Intel P4 3.0 GHz processor) and a public domain program—ImageJ 1.37 (Java based image processing program which was developed at the U.S National Institutes of Health and freely available on the internet at Hypertext Transfer Protocol://rsbweb (dot) nih (dot) gov/). Images were captured in resolution of 6 Mega Pixels (3072×2048 pixels) and stored in a low compression JPEG (Joint Photographic Experts Group standard) format. Next, analyzed data was saved to text files and processed using the JMP statistical analysis software (SAS institute).

Leaf Analysis

Using the digital analysis leaves data was calculated, including leaf number, area, perimeter, length and width. On day 30, 3-4 representative plants were chosen from each plot of blocks A, B and C. The plants were dissected, each leaf was separated and was introduced between two glass trays, a photo of each plant was taken and the various parameters (such as leaf total area, laminar length etc.) were calculated from the images (FIGS. 1*a-d*). The blade circularity was calculated as laminar width divided by laminar length.

Root Analysis

Figure 1B:
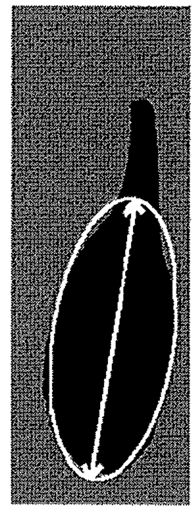
FIGS. 1*a-d* are digital images of leaves depicting leaf length (FIG. 1*a*, the leaf length is represented by the arrow), laminar length (FIG. 1*b*, the laminar length is represented by the arrow), laminar area (FIG. 1*c*, the laminar area is represented by the white ellipse) and laminar width (FIG. 1*d*, the laminar width is represented by the arrow). Blade circularity was calculated as laminar width divided by laminar length.
Figure 1D:
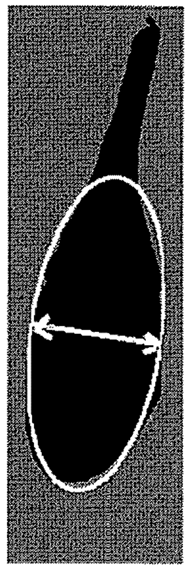
Figure 1A:
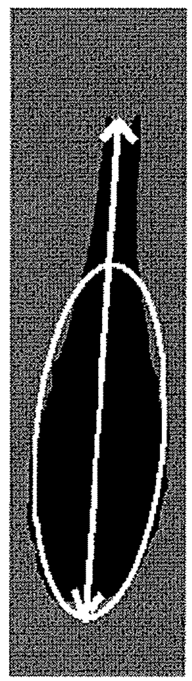
Figure 1C:
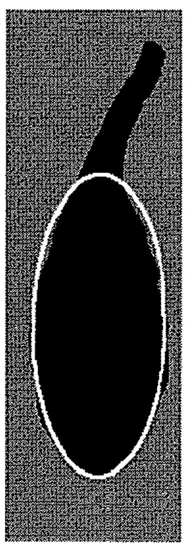
Figures 2A, 2B:
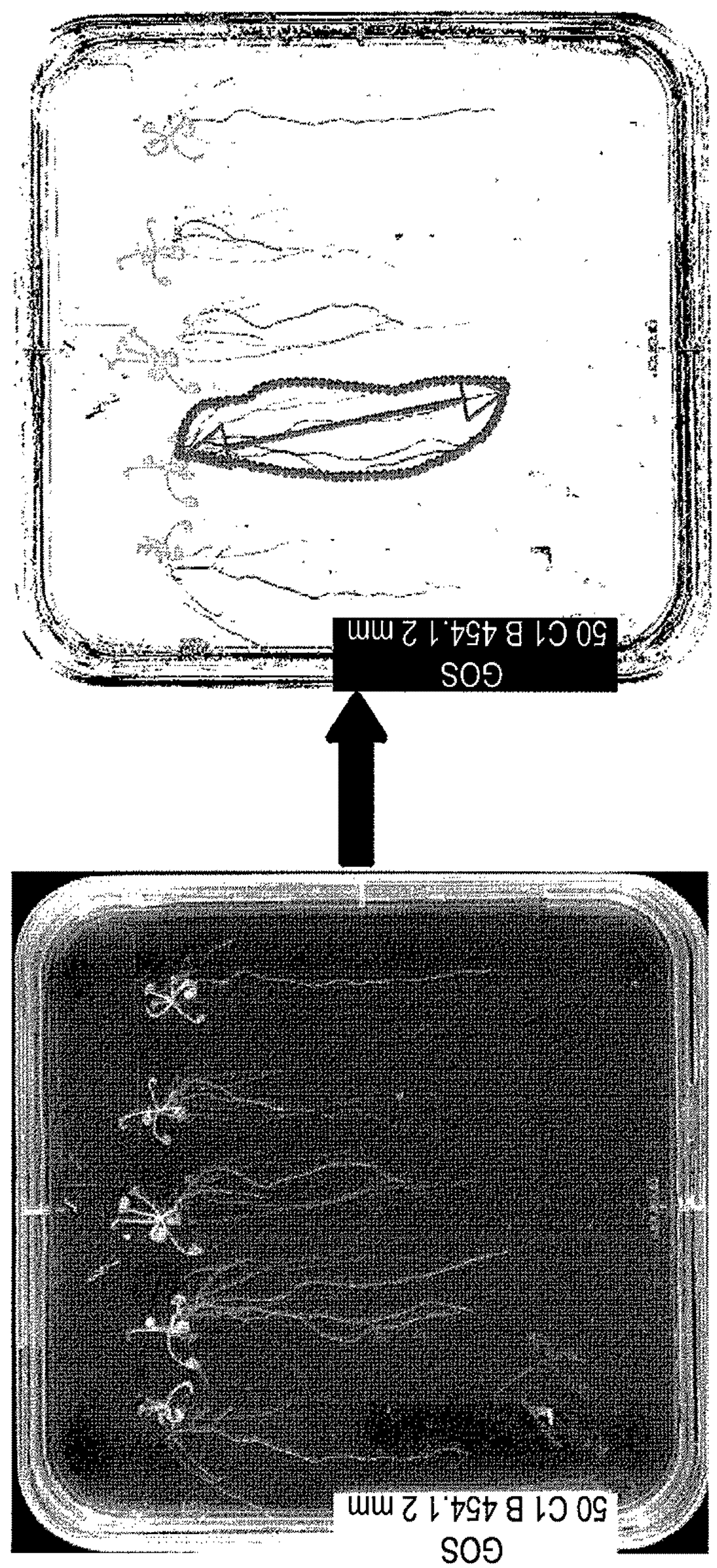
FIGS. 2*a-b* are images depicting root development of plants grown in transparent agar plates. The different ecotypes were grown in transparent agar plates for 17 days and the plates were photographed every 2 days starting at day 7. An exemplary image is shown in FIG. 2*a* (taken following 12 days on agar plates). The length of the root measured is represented by the red arrow (FIG. 2*b*).

During 17 days, the different ecotypes were grown in transparent agar plates. The plates were photographed every 2 days starting at day 7 in the photography room and the roots development was documented (FIGS. 2*a-b*).

The growth rate was calculated according to the following formula I.

$$\text{Relative growth area rate}=(\Delta\text{Area}/\Delta t)*(1/\text{Area } t0) \qquad \text{Formula I}$$

Δt is the current analyzed image day subtracted from the initial day (t−t0).

Thus, the relative growth area rate is in units of 1/day and length growth rate is in units of 1/day.

Vegetative Growth Rate Analysis

The growth rate was calculated by dividing the area added (ΔArea) by the number of days for each interval (Δt). The analysis was ended with the appearance of overlapping plants.

The growth rate was calculated according to formula II.

$$\text{Growth rate}=\Delta\text{Area}/\Delta t. \qquad \text{Formula II}$$

For comparison between ecotypes the calculated rate was normalized using plant developmental stage as represented by the number of true leaves. In cases where plants with 8 leaves had been sampled twice (for example at day 10 and day 13), only the largest sample was chosen and added to the Anova comparison.

Seeds in Siliques Analysis

On day 70, 15-17 siliques were collected from each plot in blocks D and E. The chosen siliques were light brown color but still intact. The siliques were opened in the photography room and the seeds were scatter on a glass tray, a high resolution digital picture was taken for each plot. Using the images the number of seeds per silique was determined.

Seeds Average Weight

At the end of the experiment all seeds from plots A-C were collected. An average weight of 0.02 grams was measured from each sample, the seeds were scattered on a glass tray and a picture was taken. Using the digital analysis, the number of seeds in each sample was calculated.

Oil Percentage in Seeds

At the end of the experiment all seeds from plots A-C were collected. Columbia seeds from 3 plots were mixed grounded and then mounted onto the extraction chamber. 210 ml of n-Hexane (Cat No. 080951 Biolab Ltd.) were used as the solvent. The extraction was performed for 30 hours at medium heat 50° C. Once the extraction has ended the n-Hexane was evaporated using the evaporator at 35° C. and vacuum conditions. The process was repeated twice. The information gained from the Soxhlet extractor (Soxhlet, F. Die gewichtsanalytische Bestimmung des Milchfettes, Polytechnisches J. (Dingler's) 1879, 232, 461) was used to create a calibration curve for the Low Resonance NMR. The content of oil of all seed samples was determined using the Low Resonance NMR (MARAN Ultra-Oxford Instrument) and its MultiQuant software package.

Silique Length Analysis

On day 50 from sowing, 30 siliques from different plants in each plot were sampled in block A. The chosen siliques were green-yellow in color and were collected from the bottom parts of a grown plant's stem. A digital photograph was taken to determine silique's length.

Dry weight and seed yield—On day 80 from sowing, the plants from blocks A-C were harvested and left to dry at 30° C. in a drying chamber. The biomass and seed weight of each plot was separated, measured and divided by the number of plants. Dry weight=total weight of the vegetetative portion above ground (excluding roots) after drying at 30° C. in a drying chamber; Seed yield per plant=total seed weight per plant (gr).

Oil Yield

The oil yield was calculated using Formula III.

Seed Oil yield=Seed yield per plant (gr)*Oil % in seed    Formula III

Harvest Index

The harvest index was calculated using Formula IV.

Harvest Index=Average seed yield per plant/Average dry weight    Formula IV

Experimental Results

Nine different *Arabidopsis* ecotypes were grown and characterized for 18 parameters (named as vectors). The characterized values are summarized in Tables 5 and 6 below.

TABLE 5

Table 5
*Arabidopsis* ecotypes, measured parameters

| Ecotype | Seed yield per plant (gr) | Oil yield per plant (mg) | Oil % per seed | 1000 Seed weight (gr) | Dry matter per plant (gr) | Harvest Index | Total leaf area per plant (cm) | Seeds per silique | Silique length (cm) |
|---|---|---|---|---|---|---|---|---|---|
| An-1 | 0.34 | 118.63 | 34.42 | 0.0203 | 0.64 | 0.53 | 46.86 | 45.44 | 1.06 |
| Col-0 | 0.44 | 138.73 | 31.19 | 0.0230 | 1.27 | 0.35 | 109.89 | 53.47 | 1.26 |
| Ct-1 | 0.59 | 224.06 | 38.05 | 0.0252 | 1.05 | 0.56 | 58.36 | 58.47 | 1.31 |
| Cvi (N8580) | 0.42 | 116.26 | 27.76 | 0.0344 | 1.28 | 0.33 | 56.80 | 35.27 | 1.47 |
| Gr-6 | 0.61 | 218.27 | 35.49 | 0.0202 | 1.69 | 0.37 | 114.66 | 48.56 | 1.24 |
| Kondara | 0.43 | 142.11 | 32.91 | 0.0263 | 1.34 | 0.32 | 110.82 | 37.00 | 1.09 |
| Ler-1 | 0.36 | 114.15 | 31.56 | 0.0205 | 0.81 | 0.45 | 88.49 | 39.38 | 1.18 |
| Mt-0 | 0.62 | 190.06 | 30.79 | 0.0226 | 1.21 | 0.51 | 121.79 | 40.53 | 1.18 |
| Shakdara | 0.55 | 187.62 | 34.02 | 0.0235 | 1.35 | 0.41 | 93.04 | 25.53 | 1.00 |

TABLE 6

Table 6
*Arabidopsis* ecotypes, additional measured parameters

| Ecotype | Vegetative growth rate ($cm^2$/day) till 8 true leaves | Relative root growth (cm/ day) day 13 | Root length day 7 (cm) | Root length day 13 (cm) | Fresh weight per plant (gr) at bolting stage | Lamina length (cm) | Lamina width (cm) | Leaf width/ length | Blade circularity |
|---|---|---|---|---|---|---|---|---|---|
| An-1 | 0.313 | 0.631 | 0.937 | 4.419 | 1.510 | 2.767 | 1.385 | 0.353 | 0.509 |
| Col-0 | 0.378 | 0.664 | 1.759 | 8.530 | 3.607 | 3.544 | 1.697 | 0.288 | 0.481 |
| Ct-1 | 0.484 | 1.176 | 0.701 | 5.621 | 1.935 | 3.274 | 1.460 | 0.316 | 0.450 |
| Cvi (N8580) | 0.474 | 1.089 | 0.728 | 4.834 | 2.082 | 3.785 | 1.374 | 0.258 | 0.370 |
| Gr-6 | 0.425 | 0.907 | 0.991 | 5.957 | 3.556 | 3.690 | 1.828 | 0.356 | 0.501 |
| Kondara | 0.645 | 0.774 | 1.163 | 6.372 | 4.338 | 4.597 | 1.650 | 0.273 | 0.376 |
| Ler-1 | 0.430 | 0.606 | 1.284 | 5.649 | 3.467 | 3.877 | 1.510 | 0.305 | 0.394 |
| Mt-0 | 0.384 | 0.701 | 1.414 | 7.060 | 3.479 | 3.717 | 1.817 | 0.335 | 0.491 |
| Shakdara | 0.471 | 0.782 | 1.251 | 7.041 | 3.710 | 4.149 | 1.668 | 0.307 | 0.409 |

The selected genes, their R (calculated using Pearson correlation), the characterized parameters used as x axis for correlation and the tissue transcriptom correlated with are summarized in Table 7, below.

TABLE 7

Table 7
*Arabidopsis* selected genes and their correlation with yield components among different transcriptom sets

| | Nucleotide SEQ ID NO: | Polypeptide SEQ ID NO: | Gene Name | Cluster Name | Exp. Set | Correl. Vector | R |
|---|---|---|---|---|---|---|---|
| 1 | 3 | 168 | BDL2 | *arabidopsis*\|6\|AT1G34580 | B | 8 | 0.77 |
| 2 | 3 | 168 | BDL2 | *arabidopsis*\|6\|AT1G34580 | D | 15 | 0.75 |
| 3 | 3 | 168 | BDL2 | *arabidopsis*\|6\|AT1G34580 | D | 16 | 0.71 |
| 4 | 6 | 171 | BDL6 | *arabidopsis*\|6\|AT4G10490 | E | 12 | −0.7 |

TABLE 7-continued

Table 7
*Arabidopsis* selected genes and their correlation with yield components among different transcriptom sets

| | Nucleotide SEQ ID NO: | Polypeptide SEQ ID NO: | Gene Name | Cluster Name | Exp. Set | Correl. Vector | R |
|---|---|---|---|---|---|---|---|
| 5 | 7 | 172 | BDL7 | *arabidopsis*\|6\|AT5G51490 | A | 15 | 0.76 |
| 6 | 7 | 172 | BDL7 | *arabidopsis*\|6\|AT5G51490 | A | 16 | 0.74 |
| 7 | 7 | 172 | BDL7 | *arabidopsis*\|6\|AT5G51490 | B | 4 | −0.78 |
| 8 | 7 | 172 | BDL7 | *arabidopsis*\|6\|AT5G51490 | B | 9 | −0.77 |
| 9 | 7 | 172 | BDL7 | *arabidopsis*\|6\|AT5G51490 | B | 10 | −0.73 |
| 10 | 7 | 172 | BDL7 | *arabidopsis*\|6\|AT5G51490 | B | 17 | 0.88 |
| 11 | 8 | 173 | BDL8 | *arabidopsis*\|6\|AT3G03240 | D | 15 | 0.87 |
| 12 | 8 | 173 | BDL8 | *arabidopsis*\|6\|AT3G03240 | D | 16 | 0.89 |
| 13 | 9 | 174 | BDL9 | *arabidopsis*\|6\|AT5G24130 | D | 15 | 0.75 |
| 14 | 9 | 174 | BDL9 | *arabidopsis*\|6\|AT5G24130 | D | 16 | 0.75 |
| 15 | 9 | 174 | BDL9 | *arabidopsis*\|6\|AT5G24130 | E | 13 | 0.75 |
| 16 | 10 | 175 | BDL10 | *arabidopsis*\|6\|AT5G09640 | E | 11 | 0.72 |
| 17 | 13 | 178 | BDL14 | *arabidopsis*\|6\|AT1G53690 | B | 11 | 0.87 |
| 18 | 13 | 178 | BDL14 | *arabidopsis*\|6\|AT1G53690 | B | 12 | −0.71 |
| 19 | 13 | 178 | BDL14 | *arabidopsis*\|6\|AT1G53690 | B | 14 | 0.71 |
| 20 | 13 | 178 | BDL14 | *arabidopsis*\|6\|AT1G53690 | E | 11 | 0.72 |
| 21 | 14 | 179 | BDL15 | *arabidopsis*\|6\|AT1G68510 | E | 15 | 0.72 |
| 22 | 16 | 181 | BDL17 | *arabidopsis*\|6\|AT5G36770 | D | 15 | 0.75 |
| 23 | 18 | 183 | BDL19 | *arabidopsis*\|6\|AT2G02080 | C | 16 | 0.7 |
| 24 | 18 | 183 | BDL19 | *arabidopsis*\|6\|AT2G02080 | D | 17 | 0.72 |
| 25 | 19 | 184 | BDL20a | *arabidopsis*\|6\|AT1G47540 | A | 11 | 0.85 |
| 26 | 20 | 185 | BDL20b | *arabidopsis*\|6\|AT1G47540 | A | 11 | 0.85 |
| 27 | 21 | 186 | BDL21 | *arabidopsis*\|6\|AT3G62730 | D | 17 | 0.8 |
| 28 | 21 | 186 | BDL21 | *arabidopsis*\|6\|AT3G62730 | E | 11 | 0.79 |
| 29 | 21 | 186 | BDL21 | *arabidopsis*\|6\|AT3G62730 | E | 14 | 0.79 |
| 30 | 22 | 187 | BDL22 | *arabidopsis*\|6\|AT2G27380 | A | 11 | 0.81 |
| 31 | 22 | 187 | BDL22 | *arabidopsis*\|6\|AT2G27380 | A | 12 | −0.75 |
| 32 | 23 | 188 | BDL23 | *arabidopsis*\|6\|AT3G27785 | E | 11 | 0.7 |
| 33 | 23 | 188 | BDL23 | *arabidopsis*\|6\|AT3G27785 | E | 12 | −0.86 |
| 34 | 23 | 188 | BDL23 | *arabidopsis*\|6\|AT3G27785 | E | 14 | 0.71 |
| 35 | 25 | 190 | BDL25 | *arabidopsis*\|6\|AT3G20910 | A | 5 | 0.77 |
| 36 | 25 | 190 | BDL25 | *arabidopsis*\|6\|AT3G20910 | A | 8 | 0.7 |
| 37 | 25 | 190 | BDL25 | *arabidopsis*\|6\|AT3G20910 | B | 12 | 0.72 |
| 38 | 25 | 190 | BDL25 | *arabidopsis*\|6\|AT3G20910 | B | 16 | 0.75 |
| 39 | 25 | 190 | BDL25 | *arabidopsis*\|6\|AT3G20910 | C | 15 | 0.77 |
| 40 | 25 | 190 | BDL25 | *arabidopsis*\|6\|AT3G20910 | C | 16 | 0.81 |
| 41 | 25 | 190 | BDL25 | *arabidopsis*\|6\|AT3G20910 | D | 12 | 0.77 |
| 42 | 25 | 190 | BDL25 | *arabidopsis*\|6\|AT3G20910 | D | 15 | 0.73 |
| 43 | 25 | 190 | BDL25 | *arabidopsis*\|6\|AT3G20910 | D | 16 | 0.8 |
| 44 | 26 | 191 | BDL26a | *arabidopsis*\|6\|AT1G11170 | C | 15 | −0.77 |
| 45 | 27 | 192 | BDL26b | *arabidopsis*\|6\|AT1G11170 | C | 15 | −0.77 |
| 46 | 28 | 193 | BDL27 | *arabidopsis*\|6\|AT1G68380 | A | 13 | −0.71 |
| 47 | 28 | 193 | BDL27 | *arabidopsis*\|6\|AT1G68380 | C | 13 | −0.75 |
| 48 | 28 | 193 | BDL27 | *arabidopsis*\|6\|AT1G68380 | E | 11 | 0.71 |
| 49 | 28 | 193 | BDL27 | *arabidopsis*\|6\|AT1G68380 | E | 14 | 0.74 |
| 50 | 29 | 194 | BDL28 | *arabidopsis*\|6\|AT1G09380 | C | 11 | 0.87 |
| 51 | 29 | 194 | BDL28 | *arabidopsis*\|6\|AT1G09380 | C | 12 | −0.79 |
| 52 | 29 | 194 | BDL28 | *arabidopsis*\|6\|AT1G09380 | C | 14 | 0.73 |
| 53 | 29 | 194 | BDL28 | *arabidopsis*\|6\|AT1G09380 | E | 15 | 0.83 |
| 54 | 29 | 194 | BDL28 | *arabidopsis*\|6\|AT1G09380 | E | 16 | 0.8 |
| 55 | 30 | 195 | BDL29 | *arabidopsis*\|6\|AT1G60970 | B | 9 | −0.74 |
| 56 | 30 | 195 | BDL29 | *arabidopsis*\|6\|AT1G60970 | C | 11 | 0.76 |
| 57 | 30 | 195 | BDL29 | *arabidopsis*\|6\|AT1G60970 | D | 12 | 0.87 |
| 58 | 30 | 195 | BDL29 | *arabidopsis*\|6\|AT1G60970 | D | 15 | 0.88 |
| 59 | 30 | 195 | BDL29 | *arabidopsis*\|6\|AT1G60970 | D | 16 | 0.93 |
| 60 | 30 | 195 | BDL29 | *arabidopsis*\|6\|AT1G60970 | E | 11 | 0.8 |
| 61 | 32 | 197 | BDL31 | *arabidopsis*\|6\|AT2G28490 | A | 11 | 0.85 |
| 62 | 32 | 197 | BDL31 | *arabidopsis*\|6\|AT2G28490 | A | 12 | −0.74 |
| 63 | 32 | 197 | BDL31 | *arabidopsis*\|6\|AT2G28490 | A | 14 | 0.71 |
| 64 | 35 | 200 | BDL166 | *arabidopsis*\|6\|AT1G71691 | D | 12 | 0.78 |
| 65 | 35 | 200 | BDL166 | *arabidopsis*\|6\|AT1G71691 | D | 17 | 0.72 |
| 66 | 36 | 201 | BDL_unnamed_330 | *arabidopsis*\|6\|AT1G73220 | B | 6 | 0.8 |
| 67 | 36 | 201 | BDL_unnamed_330 | *arabidopsis*\|6\|AT1G73220 | C | 12 | −0.78 |
| 68 | 36 | 201 | BDL_unnamed_330 | *arabidopsis*\|6\|AT1G73220 | C | 17 | −0.77 |
| 69 | 36 | 201 | BDL_unnamed_330 | *arabidopsis*\|6\|AT1G73220 | D | 17 | −0.76 |
| 70 | 37 | 202 | BDL_unnamed_331 | *arabidopsis*\|6\|AT5G01790 | B | 5 | 0.85 |
| 71 | 37 | 202 | BDL_unnamed_331 | *arabidopsis*\|6\|AT5G01790 | E | 14 | 0.72 |
| 72 | 38 | 203 | BDL_unnamed_333 | *arabidopsis*\|6\|AT1G71120 | B | 12 | −0.77 |
| 73 | 38 | 203 | BDL_unnamed_333 | *arabidopsis*\|6\|AT1G71120 | B | 14 | 0.77 |
| 74 | 38 | 203 | BDL_unnamed_333 | *arabidopsis*\|6\|AT1G71120 | E | 11 | 0.82 |
| 75 | 38 | 203 | BDL_unnamed_333 | *arabidopsis*\|6\|AT1G71120 | E | 14 | 0.88 |
| 76 | 39 | 204 | BDL_unnamed_334 | *arabidopsis*\|6\|AT5G38170 | D | 15 | 0.82 |

TABLE 7-continued

Table 7
*Arabidopsis* selected genes and their correlation with yield components among different transcriptom sets

| | Nucleotide SEQ ID NO: | Polypeptide SEQ ID NO: | Gene Name | Cluster Name | Exp. Set | Correl. Vector | R |
|---|---|---|---|---|---|---|---|
| 77 | 39 | 204 | BDL_unnamed_334 | *arabidopsis*\|6\|AT5G38170 | D | 16 | 0.81 |
| 78 | 39 | 204 | BDL_unnamed_334 | *arabidopsis*\|6\|AT5G38170 | E | 11 | 0.87 |
| 79 | 39 | 204 | BDL_unnamed_334 | *arabidopsis*\|6\|AT5G38170 | E | 12 | −0.75 |
| 80 | 39 | 204 | BDL_unnamed_334 | *arabidopsis*\|6\|AT5G38170 | E | 14 | 0.79 |
| 81 | 40 | 205 | BDL_unnamed_335 | *arabidopsis*\|6\|AT3G25160 | A | 1 | −0.89 |
| 82 | 40 | 205 | BDL_unnamed_335 | *arabidopsis*\|6\|AT3G25160 | A | 2 | −0.76 |
| 83 | 40 | 205 | BDL_unnamed_335 | *arabidopsis*\|6\|AT3G25160 | E | 11 | 0.71 |
| 84 | 42 | 207 | BDL_unnamed_337 | *arabidopsis*\|6\|AT2G22620 | A | 13 | −0.76 |
| 85 | 42 | 207 | BDL_unnamed_337 | *arabidopsis*\|6\|AT2G22620 | E | 15 | 0.86 |
| 86 | 42 | 207 | BDL_unnamed_337 | *arabidopsis*\|6\|AT2G22620 | E | 16 | 0.79 |
| 87 | 43 | 208 | BDL_unnamed_339 | *arabidopsis*\|6\|AT3G26480 | A | 11 | 0.84 |
| 88 | 43 | 208 | BDL_unnamed_339 | *arabidopsis*\|6\|AT3G26480 | A | 14 | 0.73 |
| 89 | 43 | 208 | BDL_unnamed_339 | *arabidopsis*\|6\|AT3G26480 | C | 11 | 0.76 |
| 90 | 43 | 208 | BDL_unnamed_339 | *arabidopsis*\|6\|AT3G26480 | C | 14 | 0.88 |
| 91 | 44 | 209 | BDL_unnamed_340 | *arabidopsis*\|6\|AT1G64660 | A | 1 | 0.83 |
| 92 | 44 | 209 | BDL_unnamed_340 | *arabidopsis*\|6\|AT1G64660 | A | 2 | 0.7 |
| 93 | 46 | 211 | BDL_unnamed_341 | *arabidopsis*\|6\|AT5G52330 | E | 17 | 0.85 |
| 94 | 49 | 214 | BDL_unnamed_343 | *arabidopsis*\|6\|AT5G64080 | C | 12 | 0.74 |
| 95 | 49 | 214 | BDL_unnamed_343 | *arabidopsis*\|6\|AT5G64080 | C | 16 | 0.77 |
| 96 | 50 | 215 | BDL_unnamed_344 | *arabidopsis*\|6\|AT2G43060 | B | 11 | 0.89 |
| 97 | 50 | 215 | BDL_unnamed_344 | *arabidopsis*\|6\|AT2G43060 | B | 12 | −0.73 |
| 98 | 50 | 215 | BDL_unnamed_344 | *arabidopsis*\|6\|AT2G43060 | B | 18 | −0.81 |
| 99 | 50 | 215 | BDL_unnamed_344 | *arabidopsis*\|6\|AT2G43060 | E | 15 | 0.8 |
| 100 | 52 | 217 | BDL_unnamed_346 | *arabidopsis*\|6\|AT2G41340 | A | 13 | −0.72 |
| 101 | 52 | 217 | BDL_unnamed_346 | *arabidopsis*\|6\|AT2G41340 | B | 5 | 0.72 |
| 102 | 52 | 217 | BDL_unnamed_346 | *arabidopsis*\|6\|AT2G41340 | B | 8 | 0.81 |
| 103 | 53 | 218 | BDL_unnamed_347 | *arabidopsis*\|6\|AT5G03450 | A | 3 | 0.76 |
| 104 | 53 | 218 | BDL_unnamed_347 | *arabidopsis*\|6\|AT5G03450 | A | 5 | 0.74 |
| 105 | 53 | 218 | BDL_unnamed_347 | *arabidopsis*\|6\|AT5G03450 | A | 15 | 0.74 |
| 106 | 53 | 218 | BDL_unnamed_347 | *arabidopsis*\|6\|AT5G03450 | D | 15 | 0.78 |
| 107 | 53 | 218 | BDL_unnamed_347 | *arabidopsis*\|6\|AT5G03450 | D | 16 | 0.82 |
| 108 | 55 | 220 | BDL_unnamed_349 | *arabidopsis*\|6\|AT4G33670 | A | 5 | 0.74 |
| 109 | 55 | 220 | BDL_unnamed_349 | *arabidopsis*\|6\|AT4G33670 | A | 15 | 0.78 |
| 110 | 55 | 220 | BDL_unnamed_349 | *arabidopsis*\|6\|AT4G33670 | A | 16 | 0.73 |
| 111 | 55 | 220 | BDL_unnamed_349 | *arabidopsis*\|6\|AT4G33670 | B | 5 | 0.86 |
| 112 | 56 | 221 | BDL_unnamed_350 | *arabidopsis*\|6\|AT5G04500 | A | 13 | −0.72 |
| 113 | 56 | 221 | BDL_unnamed_350 | *arabidopsis*\|6\|AT5G04500 | C | 15 | 0.85 |
| 114 | 56 | 221 | BDL_unnamed_350 | *arabidopsis*\|6\|AT5G04500 | C | 16 | 0.83 |
| 115 | 56 | 221 | BDL_unnamed_350 | *arabidopsis*\|6\|AT5G04500 | E | 11 | −0.72 |
| 116 | 56 | 221 | BDL_unnamed_350 | *arabidopsis*\|6\|AT5G04500 | E | 12 | 0.73 |
| 117 | 56 | 221 | BDL_unnamed_350 | *arabidopsis*\|6\|AT5G04500 | E | 17 | 0.74 |
| 118 | 57 | 222 | BDL_unnamed_351 | *arabidopsis*\|6\|AT1G27120 | B | 7 | 0.78 |
| 119 | 57 | 222 | BDL_unnamed_351 | *arabidopsis*\|6\|AT1G27120 | B | 13 | 0.74 |
| 120 | 57 | 222 | BDL_unnamed_351 | *arabidopsis*\|6\|AT1G27120 | C | 15 | 0.79 |
| 121 | 57 | 222 | BDL_unnamed_351 | *arabidopsis*\|6\|AT1G27120 | C | 16 | 0.82 |
| 122 | 57 | 222 | BDL_unnamed_351 | *arabidopsis*\|6\|AT1G27120 | D | 17 | 0.74 |
| 123 | 58 | 223 | BDL_unnamed_352 | *arabidopsis*\|6\|AT5G01820 | B | 4 | −0.71 |
| 124 | 58 | 223 | BDL_unnamed_352 | *arabidopsis*\|6\|AT5G01820 | B | 8 | −0.7 |
| 125 | 58 | 223 | BDL_unnamed_352 | *arabidopsis*\|6\|AT5G01820 | C | 15 | −0.74 |
| 126 | 58 | 223 | BDL_unnamed_352 | *arabidopsis*\|6\|AT5G01820 | E | 16 | 0.71 |
| 127 | 60 | 225 | BDL_unnamed_354 | *arabidopsis*\|6\|AT3G16490 | C | 16 | 0.73 |
| 128 | 61 | 226 | BDL_unnamed_355 | *arabidopsis*\|6\|AT5G23050 | D | 12 | 0.72 |
| 129 | 62 | 227 | BDL_unnamed_356 | *arabidopsis*\|6\|AT4G16050 | E | 11 | 0.95 |
| 130 | 62 | 227 | BDL_unnamed_356 | *arabidopsis*\|6\|AT4G16050 | E | 14 | 0.77 |
| 131 | 63 | 228 | BDL_unnamed_357 | *arabidopsis*\|6\|AT1G44760 | B | 15 | 0.73 |
| 132 | 63 | 228 | BDL_unnamed_357 | *arabidopsis*\|6\|AT1G44760 | B | 16 | 0.7 |
| 133 | 64 | 229 | BDL_unnamed_358 | *arabidopsis*\|6\|AT3G01570 | C | 16 | 0.71 |
| 134 | 66 | 231 | BDL_unnamed_362 | *arabidopsis*\|6\|AT2G25940 | B | 15 | 0.83 |
| 135 | 66 | 231 | BDL_unnamed_362 | *arabidopsis*\|6\|AT2G25940 | B | 16 | 0.84 |
| 136 | 67 | 232 | BDL_unnamed_364 | *arabidopsis*\|6\|AT1G04660 | D | 12 | 0.88 |
| 137 | 67 | 232 | BDL_unnamed_364 | *arabidopsis*\|6\|AT1G04660 | D | 15 | 0.84 |
| 138 | 67 | 232 | BDL_unnamed_364 | *arabidopsis*\|6\|AT1G04660 | D | 16 | 0.91 |
| 139 | 68 | 233 | BDL_unnamed_365 | *arabidopsis*\|6\|AT1G05160 | C | 16 | 0.71 |
| 140 | 68 | 233 | BDL_unnamed_365 | *arabidopsis*\|6\|AT1G05160 | D | 15 | 0.72 |
| 141 | 68 | 233 | BDL_unnamed_365 | *arabidopsis*\|6\|AT1G05160 | D | 16 | 0.72 |
| 142 | 70 | 235 | BDL_unnamed_367 | *arabidopsis*\|6\|AT1G19900 | B | 6 | 0.8 |
| 143 | 70 | 235 | BDL_unnamed_367 | *arabidopsis*\|6\|AT1G19900 | C | 12 | −0.86 |
| 144 | 70 | 235 | BDL_unnamed_367 | *arabidopsis*\|6\|AT1G19900 | C | 14 | 0.73 |
| 145 | 70 | 235 | BDL_unnamed_367 | *arabidopsis*\|6\|AT1G19900 | E | 15 | 0.71 |
| 146 | 71 | 236 | BDL_unnamed_368 | *arabidopsis*\|6\|AT1G23200 | D | 13 | −0.78 |
| 147 | 71 | 236 | BDL_unnamed_368 | *arabidopsis*\|6\|AT1G23200 | E | 17 | −0.73 |
| 148 | 72 | 237 | BDL_unnamed_369 | *arabidopsis*\|6\|AT1G26680 | A | 1 | 0.84 |

TABLE 7-continued

Table 7
*Arabidopsis* selected genes and their correlation with yield components among different transcriptom sets

| | Nucleotide SEQ ID NO: | Polypeptide SEQ ID NO: | Gene Name | Cluster Name | Exp. Set | Correl. Vector | R |
|---|---|---|---|---|---|---|---|
| 149 | 72 | 237 | BDL__unnamed__369 | *arabidopsis*\|6\|AT1G26680 | A | 2 | 0.75 |
| 150 | 73 | 238 | BDL__unnamed__370 | *arabidopsis*\|6\|AT1G28590 | E | 11 | 0.9 |
| 151 | 73 | 238 | BDL__unnamed__370 | *arabidopsis*\|6\|AT1G28590 | E | 12 | −0.72 |
| 152 | 74 | 239 | BDL__unnamed__371 | *arabidopsis*\|6\|AT1G48910 | B | 12 | 0.72 |
| 153 | 74 | 239 | BDL__unnamed__371 | *arabidopsis*\|6\|AT1G48910 | B | 15 | 0.79 |
| 154 | 74 | 239 | BDL__unnamed__371 | *arabidopsis*\|6\|AT1G48910 | B | 16 | 0.86 |
| 155 | 74 | 239 | BDL__unnamed__371 | *arabidopsis*\|6\|AT1G48910 | C | 17 | 0.79 |
| 156 | 79 | 244 | BDL__unnamed__374 | *arabidopsis*\|6\|AT1G62610 | D | 15 | −0.74 |
| 157 | 80 | 245 | BDL__unnamed__375 | *arabidopsis*\|6\|AT1G76290 | B | 16 | 0.72 |
| 158 | 80 | 245 | BDL__unnamed__375 | *arabidopsis*\|6\|AT1G76290 | C | 17 | 0.77 |
| 159 | 81 | 246 | BDL__unnamed__376 | *arabidopsis*\|6\|AT1G68470 | B | 4 | 0.76 |
| 160 | 81 | 246 | BDL__unnamed__376 | *arabidopsis*\|6\|AT1G68470 | B | 5 | 0.77 |
| 161 | 81 | 246 | BDL__unnamed__376 | *arabidopsis*\|6\|AT1G68470 | B | 8 | 0.96 |
| 162 | 81 | 246 | BDL__unnamed__376 | *arabidopsis*\|6\|AT1G68470 | B | 10 | 0.89 |
| 163 | 81 | 246 | BDL__unnamed__376 | *arabidopsis*\|6\|AT1G68470 | C | 15 | 0.83 |
| 164 | 81 | 246 | BDL__unnamed__376 | *arabidopsis*\|6\|AT1G68470 | C | 16 | 0.74 |
| 165 | 81 | 246 | BDL__unnamed__376 | *arabidopsis*\|6\|AT1G68470 | D | 13 | −0.81 |
| 166 | 81 | 246 | BDL__unnamed__376 | *arabidopsis*\|6\|AT1G68470 | D | 14 | −0.82 |
| 167 | 82 | 247 | BDL__unnamed__377 | *arabidopsis*\|6\|AT1G71250 | E | 11 | 0.72 |
| 168 | 82 | 247 | BDL__unnamed__377 | *arabidopsis*\|6\|AT1G71250 | E | 14 | 0.8 |
| 169 | 82 | 247 | BDL__unnamed__377 | *arabidopsis*\|6\|AT1G71250 | E | 17 | −0.7 |
| 170 | 83 | 248 | BDL__unnamed__379 | *arabidopsis*\|6\|AT3G58200 | B | 6 | 0.75 |
| 171 | 84 | 249 | BDL__unnamed__380 | *arabidopsis*\|6\|AT1G78500 | A | 1 | −0.74 |
| 172 | 84 | 249 | BDL__unnamed__380 | *arabidopsis*\|6\|AT1G78500 | B | 7 | 0.75 |
| 173 | 84 | 249 | BDL__unnamed__380 | *arabidopsis*\|6\|AT1G78500 | B | 18 | 0.84 |
| 174 | 85 | 250 | BDL__unnamed__381 | *arabidopsis*\|6\|AT2G14690 | E | 15 | −0.72 |
| 175 | 88 | 253 | BDL__unnamed__384 | *arabidopsis*\|6\|AT2G23510 | B | 12 | 0.74 |
| 176 | 88 | 253 | BDL__unnamed__384 | *arabidopsis*\|6\|AT2G23510 | B | 15 | 0.71 |
| 177 | 88 | 253 | BDL__unnamed__384 | *arabidopsis*\|6\|AT2G23510 | B | 16 | 0.8 |
| 178 | 89 | 254 | BDL__unnamed__385 | *arabidopsis*\|6\|AT2G26070 | B | 15 | 0.91 |
| 179 | 89 | 254 | BDL__unnamed__385 | *arabidopsis*\|6\|AT2G26070 | B | 16 | 0.88 |
| 180 | 90 | 255 | BDL__unnamed__386 | *arabidopsis*\|6\|AT2G28650 | D | 13 | −0.93 |
| 181 | 90 | 255 | BDL__unnamed__386 | *arabidopsis*\|6\|AT2G28650 | D | 14 | −0.87 |
| 182 | 90 | 255 | BDL__unnamed__386 | *arabidopsis*\|6\|AT2G28650 | E | 15 | 0.7 |
| 183 | 91 | 256 | BDL__unnamed__388 | *arabidopsis*\|6\|AT2G41290 | E | 11 | 0.78 |
| 184 | 93 | 258 | BDL__unnamed__390 | *arabidopsis*\|6\|AT2G47750 | B | 8 | 0.79 |
| 185 | 93 | 258 | BDL__unnamed__390 | *arabidopsis*\|6\|AT2G47750 | D | 14 | 0.84 |
| 186 | 93 | 258 | BDL__unnamed__390 | *arabidopsis*\|6\|AT2G47750 | E | 14 | 0.71 |
| 187 | 93 | 258 | BDL__unnamed__390 | *arabidopsis*\|6\|AT2G47750 | E | 17 | −0.79 |
| 188 | 94 | 259 | BDL__unnamed__391 | *arabidopsis*\|6\|AT3G03230 | D | 15 | 0.96 |
| 189 | 94 | 259 | BDL__unnamed__391 | *arabidopsis*\|6\|AT3G03230 | D | 16 | 0.95 |
| 190 | 94 | 259 | BDL__unnamed__391 | *arabidopsis*\|6\|AT3G03230 | E | 14 | −0.73 |
| 191 | 95 | 260 | BDL__unnamed__392 | *arabidopsis*\|6\|AT3G04200 | B | 7 | 0.85 |
| 192 | 95 | 260 | BDL__unnamed__392 | *arabidopsis*\|6\|AT3G04200 | B | 9 | −0.94 |
| 193 | 95 | 260 | BDL__unnamed__392 | *arabidopsis*\|6\|AT3G04200 | B | 13 | 0.78 |
| 194 | 98 | 263 | BDL__unnamed__395 | *arabidopsis*\|6\|AT3G49380 | B | 4 | −0.78 |
| 195 | 98 | 263 | BDL__unnamed__395 | *arabidopsis*\|6\|AT3G49380 | B | 9 | −0.77 |
| 196 | 98 | 263 | BDL__unnamed__395 | *arabidopsis*\|6\|AT3G49380 | B | 10 | −0.73 |
| 197 | 98 | 263 | BDL__unnamed__395 | *arabidopsis*\|6\|AT3G49380 | B | 17 | 0.88 |
| 198 | 98 | 263 | BDL__unnamed__395 | *arabidopsis*\|6\|AT3G49380 | C | 12 | 0.71 |
| 199 | 98 | 263 | BDL__unnamed__395 | *arabidopsis*\|6\|AT3G49380 | C | 15 | 0.75 |
| 200 | 98 | 263 | BDL__unnamed__395 | *arabidopsis*\|6\|AT3G49380 | C | 16 | 0.82 |
| 201 | 98 | 263 | BDL__unnamed__395 | *arabidopsis*\|6\|AT3G49380 | E | 11 | 0.82 |
| 202 | 104 | 269 | BDL__unnamed__400 | *arabidopsis*\|6\|AT4G33600 | B | 12 | 0.8 |
| 203 | 104 | 269 | BDL__unnamed__400 | *arabidopsis*\|6\|AT4G33600 | E | 11 | 0.84 |
| 204 | 104 | 269 | BDL__unnamed__400 | *arabidopsis*\|6\|AT4G33600 | E | 14 | 0.8 |
| 205 | 106 | 271 | BDL__unnamed__402 | *arabidopsis*\|6\|AT5G08460 | D | 15 | 0.77 |
| 206 | 106 | 271 | BDL__unnamed__402 | *arabidopsis*\|6\|AT5G08460 | D | 16 | 0.78 |
| 207 | 107 | 272 | BDL__unnamed__403 | *arabidopsis*\|6\|AT2G34700 | C | 11 | 0.89 |
| 208 | 107 | 272 | BDL__unnamed__403 | *arabidopsis*\|6\|AT2G34700 | C | 12 | −0.71 |
| 209 | 108 | 273 | BDL__unnamed__404 | *arabidopsis*\|6\|AT5G15740 | B | 5 | 0.74 |
| 210 | 108 | 273 | BDL__unnamed__404 | *arabidopsis*\|6\|AT5G15740 | B | 8 | 0.71 |
| 211 | 108 | 273 | BDL__unnamed__404 | *arabidopsis*\|6\|AT5G15740 | E | 15 | 0.8 |
| 212 | 109 | 274 | BDL__unnamed__405 | *arabidopsis*\|6\|AT5G16230 | A | 1 | −0.75 |
| 213 | 109 | 274 | BDL__unnamed__405 | *arabidopsis*\|6\|AT5G16230 | B | 8 | 0.83 |
| 214 | 109 | 274 | BDL__unnamed__405 | *arabidopsis*\|6\|AT5G16230 | C | 12 | −0.8 |
| 215 | 109 | 274 | BDL__unnamed__405 | *arabidopsis*\|6\|AT5G16230 | D | 12 | 0.73 |
| 216 | 109 | 274 | BDL__unnamed__405 | *arabidopsis*\|6\|AT5G16230 | D | 16 | 0.74 |
| 217 | 110 | 275 | BDL__unnamed__406 | *arabidopsis*\|6\|AT5G18290 | E | 11 | −0.76 |
| 218 | 112 | 277 | BDL__unnamed__408 | *arabidopsis*\|6\|AT5G39130 | B | 12 | 0.79 |
| 219 | 112 | 277 | BDL__unnamed__408 | *arabidopsis*\|6\|AT5G39130 | B | 13 | 0.76 |
| 220 | 112 | 277 | BDL__unnamed__408 | *arabidopsis*\|6\|AT5G39130 | B | 16 | 0.79 |

TABLE 7-continued

Table 7
*Arabidopsis* selected genes and their correlation with yield components among different transcriptom sets

| | Nucleotide SEQ ID NO: | Polypeptide SEQ ID NO: | Gene Name | Cluster Name | Exp. Set | Correl. Vector | R |
|---|---|---|---|---|---|---|---|
| 221 | 112 | 277 | BDL_unnamed_408 | *arabidopsis*\|6\|AT5G39130 | C | 14 | 0.79 |
| 222 | 112 | 277 | BDL_unnamed_408 | *arabidopsis*\|6\|AT5G39130 | D | 14 | 0.79 |
| 223 | 112 | 277 | BDL_unnamed_408 | *arabidopsis*\|6\|AT5G39130 | E | 12 | 0.73 |
| 224 | 114 | 279 | BDL_unnamed_409 | *arabidopsis*\|6\|AT5G39160 | B | 12 | 0.79 |
| 225 | 114 | 279 | BDL_unnamed_409 | *arabidopsis*\|6\|AT5G39160 | B | 13 | 0.76 |
| 226 | 114 | 279 | BDL_unnamed_409 | *arabidopsis*\|6\|AT5G39160 | B | 16 | 0.79 |
| 227 | 114 | 279 | BDL_unnamed_409 | *arabidopsis*\|6\|AT5G39160 | C | 14 | 0.79 |
| 228 | 114 | 279 | BDL_unnamed_409 | *arabidopsis*\|6\|AT5G39160 | D | 14 | 0.79 |
| 229 | 114 | 279 | BDL_unnamed_409 | *arabidopsis*\|6\|AT5G39160 | E | 12 | 0.73 |
| 230 | 115 | 280 | BDL_unnamed_410 | *arabidopsis*\|6\|AT5G39190 | B | 12 | 0.79 |
| 231 | 115 | 280 | BDL_unnamed_410 | *arabidopsis*\|6\|AT5G39190 | B | 13 | 0.76 |
| 232 | 115 | 280 | BDL_unnamed_410 | *arabidopsis*\|6\|AT5G39190 | B | 16 | 0.79 |
| 233 | 115 | 280 | BDL_unnamed_410 | *arabidopsis*\|6\|AT5G39190 | C | 14 | 0.79 |
| 234 | 115 | 280 | BDL_unnamed_410 | *arabidopsis*\|6\|AT5G39190 | D | 14 | 0.79 |
| 235 | 115 | 280 | BDL_unnamed_410 | *arabidopsis*\|6\|AT5G39190 | E | 12 | 0.73 |
| 236 | 116 | 281 | BDL_unnamed_411 | *arabidopsis*\|6\|AT5G44360 | B | 10 | −0.74 |
| 237 | 117 | 282 | BDL_unnamed_412 | *arabidopsis*\|6\|AT5G47670 | E | 11 | 0.86 |
| 238 | 117 | 282 | BDL_unnamed_412 | *arabidopsis*\|6\|AT5G47670 | E | 14 | 0.72 |
| 239 | 119 | 284 | BDL_unnamed_414 | *arabidopsis*\|6\|AT5G56300 | C | 15 | 0.77 |
| 240 | 119 | 284 | BDL_unnamed_414 | *arabidopsis*\|6\|AT5G56300 | C | 16 | 0.78 |
| 241 | 119 | 284 | BDL_unnamed_414 | *arabidopsis*\|6\|AT5G56300 | D | 15 | 0.78 |
| 242 | 119 | 284 | BDL_unnamed_414 | *arabidopsis*\|6\|AT5G56300 | D | 16 | 0.82 |
| 243 | 121 | 286 | BDL_unnamed_418 | *arabidopsis*\|6\|AT1G28640 | B | 18 | 0.81 |
| 244 | 122 | 287 | BDL_unnamed_419 | *arabidopsis*\|6\|AT1G22990 | E | 11 | 0.95 |
| 245 | 122 | 287 | BDL_unnamed_419 | *arabidopsis*\|6\|AT1G22990 | E | 14 | 0.8 |
| 246 | 123 | 288 | BDL_unnamed_420 | *arabidopsis*\|6\|AT1G64110 | B | 6 | 0.78 |
| 247 | 125 | 290 | BDL_unnamed_421 | *arabidopsis*\|6\|AT1G04380 | D | 15 | 0.73 |
| 248 | 126 | 291 | BDL_unnamed_422 | *arabidopsis*\|6\|AT1G08810 | B | 8 | 0.8 |
| 249 | 126 | 291 | BDL_unnamed_422 | *arabidopsis*\|6\|AT1G08810 | D | 14 | −0.79 |
| 250 | 126 | 291 | BDL_unnamed_422 | *arabidopsis*\|6\|AT1G08810 | D | 15 | −0.82 |
| 251 | 126 | 291 | BDL_unnamed_422 | *arabidopsis*\|6\|AT1G08810 | D | 16 | −0.82 |
| 252 | 128 | 293 | BDL_unnamed_423 | *arabidopsis*\|6\|AT1G28170 | B | 16 | −0.71 |
| 253 | 128 | 293 | BDL_unnamed_423 | *arabidopsis*\|6\|AT1G28170 | C | 11 | 0.78 |
| 254 | 128 | 293 | BDL_unnamed_423 | *arabidopsis*\|6\|AT1G28170 | C | 12 | −0.79 |
| 255 | 128 | 293 | BDL_unnamed_423 | *arabidopsis*\|6\|AT1G28170 | C | 14 | 0.75 |
| 256 | 130 | 295 | BDL_unnamed_425 | *arabidopsis*\|6\|AT3G10590 | E | 13 | 0.72 |
| 257 | 131 | 296 | BDL_unnamed_426 | *arabidopsis*\|6\|AT3G58740 | E | 14 | 0.75 |
| 258 | 131 | 296 | BDL_unnamed_426 | *arabidopsis*\|6\|AT3G58740 | E | 17 | −0.72 |
| 259 | 132 | 297 | BDL_unnamed_427 | *arabidopsis*\|6\|AT4G02360 | A | 1 | 0.85 |
| 260 | 132 | 297 | BDL_unnamed_427 | *arabidopsis*\|6\|AT4G02360 | A | 2 | 0.76 |
| 261 | 134 | 299 | BDL_unnamed_429 | *arabidopsis*\|6\|AT5G07200 | C | 13 | −0.76 |
| 262 | 134 | 299 | BDL_unnamed_429 | *arabidopsis*\|6\|AT5G07200 | D | 15 | 0.73 |
| 263 | 134 | 299 | BDL_unnamed_429 | *arabidopsis*\|6\|AT5G07200 | D | 16 | 0.73 |
| 264 | 135 | 300 | BDL_unnamed_430 | *arabidopsis*\|6\|AT5G22810 | D | 12 | 0.86 |
| 265 | 135 | 300 | BDL_unnamed_430 | *arabidopsis*\|6\|AT5G22810 | D | 15 | 0.71 |
| 266 | 135 | 300 | BDL_unnamed_430 | *arabidopsis*\|6\|AT5G22810 | D | 16 | 0.8 |
| 267 | 136 | 301 | BDL_unnamed_431 | *arabidopsis*\|6\|AT5G43860 | A | 11 | 0.75 |
| 268 | 136 | 301 | BDL_unnamed_431 | *arabidopsis*\|6\|AT5G43860 | A | 13 | −0.77 |
| 269 | 136 | 301 | BDL_unnamed_431 | *arabidopsis*\|6\|AT5G43860 | C | 11 | 0.72 |
| 270 | 136 | 301 | BDL_unnamed_431 | *arabidopsis*\|6\|AT5G43860 | C | 17 | −0.7 |
| 271 | 136 | 301 | BDL_unnamed_431 | *arabidopsis*\|6\|AT5G43860 | D | 14 | 0.71 |
| 272 | 137 | 302 | BDL_unnamed_432 | *arabidopsis*\|6\|AT5G57390 | C | 15 | 0.72 |
| 273 | 137 | 302 | BDL_unnamed_432 | *arabidopsis*\|6\|AT5G57390 | C | 16 | 0.76 |
| 274 | 137 | 302 | BDL_unnamed_432 | *arabidopsis*\|6\|AT5G57390 | D | 17 | 0.71 |
| 275 | 138 | 303 | BDL_unnamed_433 | *arabidopsis*\|6\|AT5G62800 | D | 11 | 0.76 |
| 276 | 138 | 303 | BDL_unnamed_433 | *arabidopsis*\|6\|AT5G62800 | E | 17 | −0.73 |
| 277 | 139 | 304 | BDL_unnamed_435 | *arabidopsis*\|6\|AT5G52500 | B | 5 | −0.75 |
| 278 | 139 | 304 | BDL_unnamed_435 | *arabidopsis*\|6\|AT5G52500 | B | 8 | −0.73 |
| 279 | 140 | 305 | BDL_unnamed_436 | *arabidopsis*\|6\|AT5G24600 | A | 3 | −0.78 |
| 280 | 143 | 308 | BDL_unnamed_438 | *arabidopsis*\|6\|AT1G72040 | D | 13 | 0.71 |
| 281 | 145 | 310 | BDL_unnamed_440 | *arabidopsis*\|6\|AT1G50510 | B | 8 | 0.75 |
| 282 | 146 | 311 | BDL_unnamed_441 | *arabidopsis*\|6\|AT5G48100 | E | 17 | −0.77 |
| 283 | 147 | 312 | BDL_unnamed_442 | *arabidopsis*\|6\|AT1G14760 | B | 6 | 0.83 |
| 284 | 147 | 312 | BDL_unnamed_442 | *arabidopsis*\|6\|AT1G14760 | B | 7 | −0.76 |
| 285 | 147 | 312 | BDL_unnamed_442 | *arabidopsis*\|6\|AT1G14760 | B | 9 | 0.75 |
| 286 | 148 | 313 | BDL_unnamed_443 | *arabidopsis*\|6\|AT1G15150 | B | 11 | 0.9 |
| 287 | 148 | 313 | BDL_unnamed_443 | *arabidopsis*\|6\|AT1G15150 | E | 11 | 0.76 |
| 288 | 149 | 314 | BDL_unnamed_444 | *arabidopsis*\|6\|AT1G20500 | D | 13 | −0.78 |
| 289 | 150 | 315 | BDL_unnamed_445 | *arabidopsis*\|6\|AT1G56170 | B | 6 | 0.73 |
| 290 | 150 | 315 | BDL_unnamed_445 | *arabidopsis*\|6\|AT1G56170 | D | 15 | 0.94 |
| 291 | 150 | 315 | BDL_unnamed_445 | *arabidopsis*\|6\|AT1G56170 | D | 16 | 0.93 |
| 292 | 151 | 316 | BDL_unnamed_446 | *arabidopsis*\|6\|AT1G62070 | A | 1 | 0.77 |

TABLE 7-continued

Table 7
*Arabidopsis* selected genes and their correlation with yield components among different transcriptom sets

| | Nucleotide SEQ ID NO: | Polypeptide SEQ ID NO: | Gene Name | Cluster Name | Exp. Set | Correl. Vector | R |
|---|---|---|---|---|---|---|---|
| 293 | 151 | 316 | BDL_unnamed_446 | *arabidopsis*\|6\|AT1G62070 | A | 2 | 0.77 |
| 294 | 153 | 318 | BDL_unnamed_448 | *arabidopsis*\|6\|AT3G21090 | C | 13 | 0.9 |
| 295 | 154 | 319 | BDL_unnamed_449 | *arabidopsis*\|6\|AT3G24250 | B | 6 | 0.8 |
| 296 | 154 | 319 | BDL_unnamed_449 | *arabidopsis*\|6\|AT3G24250 | C | 11 | 0.73 |
| 297 | 155 | 320 | BDL_unnamed_450 | *arabidopsis*\|6\|AT3G50990 | D | 13 | −0.85 |
| 298 | 157 | 322 | BDL_unnamed_452 | *arabidopsis*\|6\|AT4G10150 | B | 17 | −0.75 |
| 299 | 159 | 324 | BDL_unnamed_454 | *arabidopsis*\|6\|AT5G07190 | B | 17 | 0.77 |
| 300 | 159 | 324 | BDL_unnamed_454 | *arabidopsis*\|6\|AT5G07190 | B | 18 | 0.82 |
| 301 | 159 | 324 | BDL_unnamed_454 | *arabidopsis*\|6\|AT5G07190 | D | 15 | −0.92 |
| 302 | 159 | 324 | BDL_unnamed_454 | *arabidopsis*\|6\|AT5G07190 | D | 16 | −0.91 |
| 303 | 160 | 325 | BDL_unnamed_455 | *arabidopsis*\|6\|AT5G10220 | A | 10 | −0.72 |
| 304 | 160 | 325 | BDL_unnamed_455 | *arabidopsis*\|6\|AT5G10220 | E | 16 | −0.72 |
| 305 | 161 | 326 | BDL_unnamed_456 | *arabidopsis*\|6\|AT5G20940 | D | 15 | 0.76 |
| 306 | 161 | 326 | BDL_unnamed_456 | *arabidopsis*\|6\|AT5G20940 | D | 16 | 0.7 |
| 307 | 162 | 327 | BDL_unnamed_457 | *arabidopsis*\|6\|AT5G51210 | C | 17 | 0.81 |
| 308 | 163 | 328 | BDL_unnamed_458 | *arabidopsis*\|6\|AT5G55620 | A | 13 | −0.76 |
| 309 | 163 | 328 | BDL_unnamed_458 | *arabidopsis*\|6\|AT5G55620 | E | 11 | −0.81 |
| 310 | 163 | 328 | BDL_unnamed_458 | *arabidopsis*\|6\|AT5G55620 | E | 14 | −0.71 |
| 311 | 164 | 329 | BDL_unnamed_459 | *arabidopsis*\|6\|AT5G60460 | C | 14 | 0.84 |
| 312 | 164 | 329 | BDL_unnamed_459 | *arabidopsis*\|6\|AT5G60460 | E | 17 | −0.72 |
| 313 | 165 | 330 | BDL_unnamed_460 | *arabidopsis*\|6\|AT5G65590 | D | 16 | 0.72 |

Correlation vector (correl. Vector).

The following Tables 8-15 present polynucleotides which are predicted based on the microarray correlation analysis to increase in a plant the seed yield (Table 8), oil yield (Table 9), growth rate (Table 10), organ shape/size/length (Table 11), harvest index (Table 12), oil content per seed (Table 13), plant dry matter (Table 14) and seed number per silique (Table 15). It should be noted that additional polynucleotides described in the instant application can be used to change the above characteristics in plants.

TABLE 8

Table 8.
Polynucleotides which impact seed yield

| | Polynucleotide SEQ ID NO: | SEQ ID NO: of the polypeptide encoded by the polynucleotide | Gene Name |
|---|---|---|---|
| 1 | 3 | 168 | BDL2 |
| 2 | 8 | 173 | BDL8 |
| 3 | 9 | 174 | BDL9 |
| 4 | 14 | 179 | BDL15 |
| 5 | 16 | 181 | BDL17 |
| 6 | 26 | 191 | BDL26a |
| 7 | 27 | 192 | BDL26b |
| 8 | 29 | 194 | BDL28 |
| 9 | 30 | 195 | BDL29 |
| 10 | 39 | 204 | BDL_unnamed_334 |
| 11 | 42 | 207 | BDL_unnamed_337 |
| 12 | 50 | 215 | BDL_unnamed_344 |
| 13 | 53 | 218 | BDL_unnamed_347 |
| 14 | 55 | 220 | BDL_unnamed_349 |
| 15 | 56 | 221 | BDL_unnamed_350 |
| 16 | 57 | 222 | BDL_unnamed_351 |
| 17 | 63 | 228 | BDL_unnamed_357 |
| 18 | 66 | 231 | BDL_unnamed_362 |
| 19 | 68 | 233 | BDL_unnamed_365 |
| 20 | 70 | 235 | BDL_unnamed_367 |
| 21 | 74 | 239 | BDL_unnamed_371 |
| 22 | 79 | 244 | BDL_unnamed_374 |
| 23 | 81 | 246 | BDL_unnamed_376 |

TABLE 8-continued

Table 8.
Polynucleotides which impact seed yield

| | Polynucleotide SEQ ID NO: | SEQ ID NO: of the polypeptide encoded by the polynucleotide | Gene Name |
|---|---|---|---|
| 24 | 88 | 253 | BDL_unnamed_384 |
| 25 | 89 | 254 | BDL_unnamed_385 |
| 26 | 94 | 259 | BDL_unnamed_391 |
| 27 | 98 | 263 | BDL_unnamed_395 |
| 28 | 106 | 271 | BDL_unnamed_402 |
| 29 | 108 | 273 | BDL_unnamed_404 |
| 30 | 119 | 284 | BDL_unnamed_414 |
| 31 | 125 | 290 | BDL_unnamed_421 |
| 32 | 126 | 291 | BDL_unnamed_422 |
| 33 | 134 | 299 | BDL_unnamed_429 |
| 34 | 137 | 302 | BDL_unnamed_432 |
| 35 | 150 | 315 | BDL_unnamed_445 |
| 36 | 159 | 324 | BDL_unnamed_454 |
| 37 | 161 | 326 | BDL_unnamed_456 |

TABLE 9

Table 9
Polynucleotides which impact oil yield

| | Polynucleotide SEQ ID NO: | SEQ ID NO: of the polypeptide encoded by the polynucleotide | Gene Name |
|---|---|---|---|
| 1 | 18 | 183 | BDL19 |
| 2 | 25 | 190 | BDL25 |
| 3 | 49 | 214 | BDL_unnamed_343 |
| 4 | 57 | 222 | BDL_unnamed_351 |
| 5 | 60 | 225 | BDL_unnamed_354 |
| 6 | 64 | 229 | BDL_unnamed_358 |
| 7 | 67 | 232 | BDL_unnamed_364 |
| 8 | 109 | 274 | BDL_unnamed_405 |

TABLE 9-continued

| | Table 9<br>Polynucleotides which impact oil yield | | |
|---|---|---|---|
| | Polynucleotide SEQ ID NO: | SEQ ID NO: of the polypeptide encoded by the polynucleotide | Gene Name |
| 9 | 135 | 300 | BDL_unnamed_430 |
| 10 | 160 | 325 | BDL_unnamed_455 |
| 11 | 165 | 330 | BDL_unnamed_460 |

TABLE 10

| | Table 10<br>Polynucleotides which impact growth rate | | |
|---|---|---|---|
| | Polynucleotide SEQ ID NO: | SEQ ID NO: of the polypeptide encoded by the polynucleotide | Gene Name |
| 1 | 36 | 201 | BDL_unnamed_330 |
| 2 | 70 | 235 | BDL_unnamed_367 |
| 3 | 83 | 248 | BDL_unnamed_379 |
| 4 | 123 | 288 | BDL_unnamed_420 |
| 5 | 140 | 305 | BDL_unnamed_436 |
| 6 | 147 | 312 | BDL_unnamed_442 |
| 7 | 150 | 315 | BDL_unnamed_445 |
| 8 | 154 | 319 | BDL_unnamed_449 |

TABLE 11

| | Table 11.<br>Polynucleotides which impact organ shape/size/length | | |
|---|---|---|---|
| | Polynucleotide SEQ ID NO: | SEQ ID NO: of the polypeptide encoded by the polynucleotide | Gene Name |
| 1 | 10 | 175 | BDL10 |
| 2 | 13 | 178 | BDL14 |
| 3 | 19 | 184 | BDL20a |
| 4 | 20 | 185 | BDL20b |
| 5 | 21 | 186 | BDL21 |
| 6 | 22 | 187 | BDL22 |
| 7 | 28 | 193 | BDL27 |
| 8 | 38 | 203 | BDL_unnamed_333 |
| 9 | 40 | 205 | BDL_unnamed_335 |
| 10 | 40 | 205 | BDL_unnamed_335 |
| 11 | 43 | 208 | BDL_unnamed_339 |
| 12 | 44 | 209 | BDL_unnamed_340 |
| 13 | 62 | 227 | BDL_unnamed_356 |
| 14 | 72 | 237 | BDL_unnamed_369 |
| 15 | 73 | 238 | BDL_unnamed_370 |
| 16 | 81 | 246 | BDL_unnamed_376 |
| 17 | 82 | 247 | BDL_unnamed_377 |
| 18 | 84 | 249 | BDL_unnamed_380 |
| 19 | 91 | 256 | BDL_unnamed_388 |
| 20 | 93 | 258 | BDL_unnamed_390 |
| 21 | 95 | 260 | BDL_unnamed_392 |
| 22 | 104 | 269 | BDL_unnamed_400 |
| 23 | 109 | 274 | BDL_unnamed_405 |
| 24 | 110 | 275 | BDL_unnamed_406 |
| 25 | 116 | 281 | BDL_unnamed_411 |
| 26 | 117 | 282 | BDL_unnamed_412 |
| 27 | 121 | 286 | BDL_unnamed_418 |
| 28 | 122 | 287 | BDL_unnamed_419 |
| 29 | 126 | 291 | BDL_unnamed_422 |
| 30 | 128 | 293 | BDL_unnamed_423 |
| 31 | 132 | 297 | BDL_unnamed_427 |
| 32 | 136 | 301 | BDL_unnamed_431 |
| 33 | 138 | 303 | BDL_unnamed_433 |
| 34 | 145 | 310 | BDL_unnamed_440 |
| 35 | 148 | 313 | BDL_unnamed_443 |
| 36 | 151 | 316 | BDL_unnamed_446 |

TABLE 11-continued

| | Table 11.<br>Polynucleotides which impact organ shape/size/length | | |
|---|---|---|---|
| | Polynucleotide SEQ ID NO: | SEQ ID NO: of the polypeptide encoded by the polynucleotide | Gene Name |
| 37 | 154 | 319 | BDL_unnamed_449 |
| 38 | 163 | 328 | BDL_unnamed_458 |

Organ shape/size/length include for example, leaf length, leaf width, leaf circularity, seed size, or root length.

TABLE 12

| | Table 12<br>Polynucleotides which impact harvest index | | |
|---|---|---|---|
| | Polynucleotide SEQ ID NO: | SEQ ID NO: of the polypeptide encoded by the polynucleotide | Gene Name |
| 1 | 7 | 172 | BDL7 |
| 2 | 18 | 183 | BDL19 |
| 3 | 36 | 201 | BDL_unnamed_330 |
| 4 | 46 | 211 | BDL_unnamed_341 |
| 5 | 56 | 221 | BDL_unnamed_350 |
| 6 | 80 | 245 | BDL_unnamed_375 |
| 7 | 93 | 258 | BDL_unnamed_390 |
| 8 | 98 | 263 | BDL_unnamed_395 |
| 9 | 131 | 296 | BDL_unnamed_426 |
| 10 | 136 | 301 | BDL_unnamed_431 |
| 11 | 138 | 303 | BDL_unnamed_433 |
| 12 | 146 | 311 | BDL_unnamed_441 |
| 13 | 157 | 322 | BDL_unnamed_452 |
| 14 | 162 | 327 | BDL_unnamed_457 |
| 15 | 164 | 329 | BDL_unnamed_459 |

TABLE 13

| | Table 13<br>Polynucleotides which impact oil content per seed | | |
|---|---|---|---|
| | Polynucleotide SEQ ID NO: | SEQ ID NO: of the polypeptide encoded by the polynucleotide | Gene Name |
| 1 | 6 | 171 | BDL6 |
| 2 | 23 | 188 | BDL23 |
| 3 | 56 | 221 | BDL_unnamed_350 |
| 4 | 61 | 226 | BDL_unnamed_355 |
| 5 | 112 | 277 | BDL_unnamed_408 |
| 6 | 114 | 279 | BDL_unnamed_409 |
| 7 | 115 | 280 | BDL_unnamed_410 |
| 8 | 128 | 293 | BDL_unnamed_423 |
| 9 | 135 | 300 | BDL_unnamed_430 |

TABLE 14

| | Table 14<br>Polynucleotides which impact plant dry matter | | |
|---|---|---|---|
| | Polynucleotide SEQ ID NO: | SEQ ID NO: of the polypeptide encoded by the polynucleotide | Gene Name |
| 1 | 37 | 202 | BDL_unnamed_331 |
| 2 | 52 | 217 | BDL_unnamed_346 |
| 3 | 55 | 220 | BDL_unnamed_349 |
| 4 | 139 | 304 | BDL_unnamed_435 |

TABLE 15

| | Polynucleotide SEQ ID NO: | SEQ ID NO: of the polypeptide encoded by the polynucleotide | Gene Name |
|---|---|---|---|
| 1 | 57 | 222 | BDL_unnamed_351 |
| 2 | 71 | 236 | BDL_unnamed_368 |
| 3 | 81 | 246 | BDL_unnamed_376 |
| 4 | 90 | 255 | BDL_unnamed_386 |
| 5 | 112 | 277 | BDL_unnamed_408 |
| 6 | 114 | 279 | BDL_unnamed_409 |
| 7 | 115 | 280 | BDL_unnamed_410 |
| 8 | 131 | 296 | BDL_unnamed_426 |
| 9 | 143 | 308 | BDL_unnamed_438 |
| 10 | 149 | 314 | BDL_unnamed_444 |
| 11 | 153 | 318 | BDL_unnamed_448 |
| 12 | 155 | 320 | BDL_unnamed_450 |

Table 15: Polynucleotides which impact seed number per silique

Example 3

Gene Cloning and Creation of Binary Vectors for Plant Expression

Cloning Strategy

Selected genes from those listed in Examples 1 and 2 above were cloned into binary vectors for the generation of transgenic plants. For cloning, the full-length open reading frame (ORF) was first identified. In case of ORF-EST clusters and in some cases mRNA sequences were analyzed to identify the entire open reading frame by comparing the results of several translation algorithms to known proteins from other plant species. To clone the full-length cDNAs, Reverse Transcription followed by PCR(RT-PCR) was performed on total RNA extracted from *Arabidopsis* siliques collected 3 and 13 days after flowering (3 and 13 DAF). RNA was extracted using Hot Borate RNA Extraction protocol according to World Wide Web (dot) www (dot) eeob (dot) iastate (dot) edu/faculty/WendelJ/ultramicrorna (dot) html. Production of cDNA (using random hexamer and poly dT primers) and PCR amplification was performed using standard protocols described elsewhere (Sambrook J., E. F. Fritsch, and T. Maniatis. 1989. Molecular Cloning. A Laboratory Manual., 2nd Ed. Cold Spring Harbor Laboratory Press, New York.) and are routine for those skilled in the art.

To clone the full-length genomic region of a gene, genomic DNA was extracted from wild type (WT) *Arabidopsis thaliana* leaves (DNeasy plant mini kit, Qiagen, Germany). All genes were amplified by nested PCR. PCR products were purified using Mini Elute PCR purification kit (Qiagen) and sequencing of the amplified PCR products is performed, using ABI 377 sequencer (Applied Biosystems). To facilitate cloning of the cDNAs/genomic sequences, a 8-12 bp extension was added to the 5' prime end of each primer. The primer extension includes an endonuclease restriction site. The restriction sites are selected using two parameters: (a). The site does not exist in the cDNA sequence; and (b). The restriction sites in the forward and reverse primers are designed so the digested cDNA is inserted in the sense formation into the binary vector utilized for transformation.

PCR products were purified (Mini Elute PCR Purification Kit, Qiagen, Germany) and digested with the restriction sites according to the primers used (Roche, Switzerland). The digested PCR products were first subcloned into a high copy vector [(originated from the pBlue-script KS plasmid vector http://www.stratagene.com/manuals/212205.pdf)] with the 35S promoter (SEQ ID NO:921), and the NOS terminator (SEQ ID NO:922) originated from pBI 101.3 binary vector (GenBank Accession No. U12640, bp 4417 to 4693)), followed by cloning the entire cassette into the binary vectors pGI or pMBArt (according to Table 16, hereinbelow). The digested PCR products and the linearized plasmid vector were ligated using T4 DNA ligase enzyme (Roche, Switzerland). The following polynucleotides were cloned from RNA extracted from the tissues described above or genomic DNA using the primers as provided in Table 17, below.

TABLE 16

Table 16: Genes cloned into different binary vectors

| | Bioinf. identified Polynucleotide SEQ ID NO: | Bioinf. identified Polypeptide SEQ ID NO: | TAIR gene name | Internal name | Cloned polynucleotide SEQ ID NO: | Cloned In pGI | Cloned In pMBart |
|---|---|---|---|---|---|---|---|
| 1 | 1 | 166 | AT5G50770 | BDL3 | 1017 | | V |
| 2 | 4 | 169 | AT2G45420 | BDL4 | 1041 | | V |
| 3 | 5 | 170 | AT3G14360 | BDL5 | 1018 | | V |
| 4 | 6 | 171 | AT4G10490 | BDL6 | 1019 | V | |
| 5 | 7 | 172 | AT5G51490 | BDL7 | 1020 | V | |
| 6 | 8 | 173 | AT3G03240 | BDL8 | 1021 | | V |
| 7 | 9 | 174 | AT5G24130 | BDL9 | 1022 | | V |
| 8 | 3 | 168 | AT1G34580 | BDL2 | 1016 | | V |
| 9 | 11 | 176 | AT5G12460 | BDL11 | 1042 | | V |
| 10 | 12 | 177 | AT4G08530 | BDL12 | 1023 | V | |
| 11 | 2 | 167 | AT1G65090 | BDL1 | 1040 | V | |
| 12 | 13 | 178 | AT1G53690 | BDL14 | 1024 | V | |
| 13 | 14 | 179 | AT1G68510 | BDL15 | 1025 | V | |
| 14 | 15 | 180 | AT5G03800 | BDL16 | 1026 | | V |
| 15 | 16 | 181 | AT5G36770 | BDL17 | 1043 | | V |
| 16 | 17 | 182 | AT5G40420 | BDL18 | 1027 | V | |
| 17 | 19 | 184 | AT1G47540.1 | BDL20a | 1029 | V | |
| 18 | 20 | 185 | AT1G47540.2 | BDL20b | 1044 | V | |
| 19 | 21 | 186 | AT3G62730 | BDL21 | 1030 | | V |
| 20 | 23 | 188 | AT3G27785 | BDL23 | 1031 | | V |
| 21 | 24 | 189 | AT5G15000 | BDL24 | 1045 | V | |
| 22 | 25 | 190 | AT3G20910 | BDL25 | 1032 | | V |
| 23 | 26 | 191 | AT1G11170.1 | BDL26a | 1033 | V | |

TABLE 16-continued

Table 16: Genes cloned into different binary vectors

| | Bioinf. identified Polynucleotide SEQ ID NO: | Bioinf. identified Polypeptide SEQ ID NO: | TAIR gene name | Internal name | Cloned polynucleotide SEQ ID NO: | Cloned In pGI | Cloned In pMBart |
|---|---|---|---|---|---|---|---|
| 24 | 27 | 192 | AT1G11170.2 | BDL26b | 1034 | V | |
| 25 | 28 | 193 | AT1G68380 | BDL27 | 1035 | | V |
| 26 | 29 | 194 | AT1G09380 | BDL28 | 1036 | | V |
| 27 | 30 | 195 | AT1G60970 | BDL29 | 1037 | | V |
| 28 | 31 | 196 | AT1G72580 | BDL30 | 1046 | V | |
| 29 | 33 | 198 | AT2G46960.1 | BDL32a | 1038 | | V |
| 30 | 34 | 199 | AT2G46960.2 | BDL32b | 1039 | | V |
| 31 | 933 | 183 | AT2G02080.1 | BDL19gD NA | 1028 | | V |
| 32 | — | AY254038 | WRINKLED1 | WRI | 1050 | V | |

Provided are the sequence identifiers of the polynucleotides and polypeptides identified bioinformatically (bioinf.), as well as the sequence identifiers of the cloned polynucleotides. In two cases, the translated polypeptide sequences of the cloned genes were different from the predicted bioinformatically identified polypeptides (SEQ ID NOs: 176 and 178) and new sequence identifiers were provided (i.e., SEQ ID NO: 1047 for the translated polypeptide of cloned gene SEQ ID NO: 1042 and SEQ ID NO: 1048 for the translated polypeptide of cloned gene SEQ ID NO: 1024).

TABLE 17

Table 17 Polynucleotides cloned from cDNA libraries, genomic DNA or synthetically produced and the primers used for the cloning

| Gene Name | Restriction Enzymes used for cloning | Primers used for amplification (5'→3') | SEQ ID NO: |
|---|---|---|---|
| BDL3 | SalI, XbaI | Fwd Nested: BDL3_ORF_NF_SalI-AATGTCGACGATGCATGGATTCAATCAACA | 923 |
| | | Fwd External: BDL3_ORF_EF_SalI-TTTGTCGACCATTGTGAAGTATAGTCCTTGATG | 924 |
| | | Rev Nested: BDL3_ORF_NR_XbaI-TATCTAGAACATAAACGGGGAGACTCAAG | 925 |
| | | Rev External: BDL3_ORF_ER_XbaI-AATCTAGACTATGGTAACCCGAAGTTGTATAC | 926 |
| BDL4 | SacI, XbaI | synthetic product | 1041 |
| BDL5 | SalI, XbaI | Fwd Nested: BDL5_ORF_NF_Sal-ACTGTCGACAGACATGCACAAAGACAACG | 927 |
| | | Fwd External: BDL5_ORF_EF_SalI-ATAGTCGACCAAAACCCAGAGACATGCAC | 928 |
| | | Rev Nested: BDL5_ORF_NR_XbaI-AATCTAGACACTTTTCAAAGAGAGGACATCT | 929 |
| | | Rev External: BDL5_ORF_ER_XbaI-ACTCTAGACCGGTTCACTTAAGATTTATTC | 930 |
| BDL6 | SalI, XbaI | Fwd: BDL6_ORF_F1_SalI-AAAGTCGACCAATCATGGCAGCATCAAAAC | 931 |
| | | Rev Nested: BDL6_ORF_NR_XbaI-AGTCTAGACGGATGATTGATTCGATAGTACAC *Phaseolus vulgaris* | 932 |
| | | Rev External: BDL6_ORF_ER_SacI-TGAGCTCCCAATCAAGAACTAAGGACCG | 933 |
| BDL7 | SalI, XbaI | Fwd: BDL7_ORF_F1_Sal-AATGTCGACAACAATGAATATGATGATGCAAAAACTC | 934 |
| | | Rev Nested: BDL7_ORF_NR_XbaI-AATCTAGACGGTCTTTAGAGTCCAGAAGTG | 935 |

TABLE 17-continued

Table 17
Polynucleotides cloned from cDNA libraries, genomic DNA or synthetically produced and the primers used for the cloning

| Gene Name | Restriction Enzymes used for cloning | Primers used for amplification (5'→3') | SEQ ID NO: |
|---|---|---|---|
| | | Rev External: BDL7_ORF_ER_XbaI-AATCTAGAATCATTGCAACTTAAACACGA | 936 |
| BDL8 | XbaI, SalI | Fwd: BDL8_gDNA_F_Sal-AATGTCGACCCTCTGTCTTGTCTTTTGGTTAGTA | 937 |
| | | Rev: BDL8_gDNA_R_Xb-AATCTAGACCTTCAACTACAAGCGGCTT | 938 |
| BDL9 | SalI, XbaI | Fwd Nested: BDL9_ORF_NF_SalI-acggtcgacCTTACAATAAAATGGTGAAACTCG | 939 |
| | | Fwd External: BDL9_ORF_EF_SalI-aatgtcgacCTCTCTAAACGCATAATCTTACA | 940 |
| | | Rev Nested: BDL9_ORF_NR_XbaI-AATCTAGACAAAATATGTGGTCTCCGCAG | 941 |
| | | Rev External: BDL9_ORF_ER_XbaI-AGTCTAGACAAAAAGGAAACGAATCACA | 942 |
| BDL2 | SalI, XbaI | Fwd Nested: BDL2_ORF_NF_SalI-CAAGTCGACCGTAAGACATAAGCAAAATGGC | 943 |
| | | Fwd External BDL2_ORF_EF_SalI-TTAGTCGACCACTTCATGCGTAAGACATAAGC | 944 |
| | | Rev Nested: BDL2_ORF_NR_XbaI-GCTCTAGAGCATCTTTTAAGTTGACGTCG | 945 |
| | | Rev External: BDL2_ORF_ER_XbaI-AATCTAGATCCATTGAAAATGCGAACC | 946 |
| BDL11 | SacI, XbaI | synthetic product | |
| BDL12 | SalI, SacI | Fwd Nested: BDL12_gDNA_NF_SalI-AATGTCGACGTTCTATCCCCAACTCTAAATG | 947 |
| | | Fwd External: BDL12_gDNA_EF_XbaI-ATTCTAGATTGTTGTTTGTATCACTTTATTGG | 948 |
| | | Rev Nested: BDL12_gDNA_NR_SacI-AGAGCTCCTTAAAGTTCTATCGAGATAGTGC | 949 |
| | | Rev External: BDL12_gDNA_ER_SacI-AGAGCTCTCAATGAAATTTTACATAACCATC | 950 |
| BDL1 | XbaI, SacI | synthetic product | |
| BDL14 | SalI, XbaI | Fwd: BDL14_ORF_F1_SalI-AATGTCGACAACAATGGATCTACAACAGTCCGAAAC | 951 |
| | | Rev Nested: BDL14_ORF_NR_XbaI-AATCTAGACACTCAGACAGCTGGGTATTAAAC | 952 |
| | | Rev External: BDL14_ORF_ER_SacI-AGAGCTCGTTGTGGCACTCAGACAGCTG | 953 |
| BDL15 | SalI, XbaI | Fwd Nested: BDL15_ORF_NF_Sal-TTCGTCGACAAAGGAATATGAGAATCAGCTG | 954 |
| | | Fwd External: BDL15_ORF_EF_Sal-AACGTCGACCAAACACACATCATACGTATATTTG | 955 |
| | | Rev Nested: BDL15_ORF_NR_XbaI-ATTCTAGAGAGTTTATGATAACCTAATGATTGAC | 956 |
| | | Rev External: BDL15_ORF_ER_XbaI-GTTCTAGACAGAGTGAGTTTATGATAACCTAATG | 957 |

TABLE 17-continued

Table 17
Polynucleotides cloned from cDNA libraries, genomic DNA or synthetically produced and the primers used for the cloning

| Gene Name | Restriction Enzymes used for cloning | Primers used for amplification (5'→3') | SEQ ID NO: |
|---|---|---|---|
| BDL16 | SalI, XbaI | Fwd: BDL16_ORF_F1_SalI- AATGTCGACAACAATGTCCACCGTTAATCATCAC | 958 |
| | | Rev Nested: BDL16_ORF_NR_XbaI- AATCTAGACAGAACCAAAACTCTCGTATTAAC | 959 |
| | | Rev External: BDL16_ORF_ER_XbaI- AATCTAGAGAAACTTTGAATGGACTATGTAGC | 960 |
| BDL17 | SacI, XbaI | synthetic product | 1043 |
| BDL18 | XbaI, SacI | Fwd Nested: BDL18_ORF_NF_XbaI- AATCTAGATACAATGGCGGATACACACC | 961 |
| | | Fwd External: BDL18_ORF_EF_XbaI- ATTCTAGAGCTTACAATGGCGGATACACA | 962 |
| | | Rev Nested: BDL18_ORF_NR_SacI- AGAGCTCGTGAAAACACATATCTACCGTTC | 963 |
| | | Rev External: BDL18_ORF_ER_SacI- AGAGCTCCTTGCGATCTTTCATGCTTAC | 964 |
| BDL19 | SacI | Fwd Nested: BDL19_gDNA_NF_SacI- AGAGCTCAGAGAGAGATAGGGCTTTGAGG | 965 |
| | | Fwd External: BDL19_g_DNA_EF_SacI- AGAGCTCGAAGAAGAACACAAAACAGTAGAG | 966 |
| | | Rev: BDL19_gDNA_R1_SacI- AGAGCTCGTGATTATGAAAACAACAAGCG | 967 |
| BDL20a | SalI, XbaI | Fwd: BDL20a_ORF_F1_SalI- AAAGTCGACAGAGACAAAGAAGTTGGCCA | 968 |
| | | Rev Nested: BDL20a_ORF_NR_XbaI- TTTCTAGATGCAAGATTCAAATACGACTTAG | 969 |
| | | Rev External: BDL20a_ORF_ER_SacI- AGAGCTCGGACCATTTACCTTGATTTGTTAC | 970 |
| BDL20b | SmaI + SacI | synthetic product | 1044 |
| BDL21 | SalI, XbaI | Fwd Nested: BDL21-ORF-NF-Sal- AATGTCGACAAGCATGTTTAAACTCTGTCTCG | 971 |
| | | Fwd External: BDL21-ORF-EF-Sal- TTAGTCGACGAAAGGAAAAGCATGTTTAAAC | 972 |
| | | Rev Nested: BDL21-ORF-NR-XbaI- CCGTCTAGAGGAAACTTTTAATTGTCATGTGA | 973 |
| | | Rev External: BDL21-ORF-ER-XbaI- GGCTCTAGATTTTCTAGTGAATTGTATCAATGG | 974 |
| BDL23 | XbaI, SacI | Fwd Nested: BDL23_ORF_NF_XbaI- AATCTAGACATCATAATCATATGGAGTTCGA | 975 |
| | | Fwd External: BDL23_ORF_EF_XbaI- AATCTAGAGATCTAGGGTTTCATGCTTCAC | 976 |
| | | Rev: BDL23_ORF_R1_SacI- AGAGCTCGTTCGACTTGTTTATATTGCACG | 977 |
| BDL24 | SmaI, SacI | synthetic product | 1045 |
| BDL25 | XbaI | Fwd Nested: BDL25_ORF_NF_XbaI- ATTCTAGACTCCGAGACTGTCTCCGATTG | 978 |

TABLE 17-continued

Table 17
Polynucleotides cloned from cDNA libraries, genomic DNA or synthetically produced and the primers used for the cloning

| Gene Name | Restriction Enzymes used for cloning | Primers used for amplification (5'→3') | SEQ ID NO: |
|---|---|---|---|
| | | Fwd External: BDL25_ORF_EF_XbaI-ATTCTAGACAATCACCGTGGACACCTC | 979 |
| | | Rev: BDL25_ORF_R_XbaI-ATTCTAGAGTGGCAACATCTGAAGTATTCC | 980 |
| BDL26a | SacI | Fwd Nested: BDL26a_ORF_NF_SacI-AGAGCTCTCATTACAGTGACTCTGCATGC | 981 |
| | | Fwd External: BDL26a_ORF_EF_SacI-AGAGCTCTCTTGTCTACTTTTCATTACAGTGAC | 982 |
| | | Rev Nested: BDL26a + b_ORF_NR_SacI-TAGAGCTCGAAAGTACATAATGGACATGAGC | 983 |
| | | Rev External: BDL26a + b_ORF_ER_SacI-TAGAGCTCGATTTTTAAAGTAGTTATAGTGATGAA | 984 |
| BDL26b | SacI | Fwd Nested: BDL26b_ORF_NF_SacI-AGAGCTCGTAATATTACCATAAGGTTCAGAAG | 985 |
| | | Fwd External: BDL26b_ORF_EF_SacI-AGAGCTCCATAATTTTTTCGTATTTAACTCTT | 986 |
| | | Rev Nested: BDL26a + b_ORF_NR_SacI-TAGAGCTCGAAAGTACATAATGGACATGAGC | 987 |
| | | Rev external: BDL26a + b_ORF_ER_SacI-TAGAGCTCGATTTTTAAAGTAGTTATAGTGATGAA | 988 |
| BDL27 | XbaI, SacI | Fwd Nested: BDL27_ORF_NF_XbaI-AATCTAGACTCTTACACATGTATCGGTAGTTG | 989 |
| | | Fwd External: BDL27_ORF_EF_XbaI-AATCTAGACTTAAAACATTGGAAACAAGAATTC | 990 |
| | | Rev Nested: BDL27_ORF_NR_SacI-AGAGCTCGATCAGAAATACATGACGATAGATG | 991 |
| | | Rev External: BDL27_ORF_ER_SacI-AGAGCTCGCATCTTTGTTTTTGGACGA | 992 |
| BDL28 | SalI, xbaI | Fwd Nested: BDL28_ORF_NF_SalI-AAAGTCGACGAGAGATGGCTAAATCAGATATG | 993 |
| | | Fwd External: BDL28_ORF_EF_SalI-AATGTCGACGAGAGTGAGAGATGGCTAAATCAG | 994 |
| | | Rev Nested: BDL28_ORF_NR_XbaI-ATTCTAGAAGAAGCAATCACCATTTTAAGG | 995 |
| | | Rev External: BDL28_ORF_ER_XbaI-ATTCTAGACCGAAAATCCAATTTAGTTGC | 996 |
| BDL29 | SalI, XbaI | Fwd Nested: BDL29_ORF_NF_SalI-AATGTCGACGATTTCTTCTCCTTAAGCCATG | 997 |
| | | Fwd External: BDL29_ORF_EF_SalI-AATGTCGACGGAGAGTTTTTCTTTATTACTAGGG | 998 |
| | | Rev Nested: BDL29_ORF_NR_XbaI-AATCTAGACACACATCATTTCATAAGTGACC | 999 |
| | | Rev External: BDL29_ORF_ER_XbaI-AATCTAGACAACCATTATTACCGAAGAGC | 1000 |

TABLE 17-continued

Table 17
Polynucleotides cloned from cDNA libraries, genomic DNA or synthetically produced and the primers used for the cloning

| Gene Name | Restriction Enzymes used for cloning | Primers used for amplification (5'→3') | SEQ ID NO: |
|---|---|---|---|
| BDL30 | SmaI, SacI | synthetic product | 1046 |
| BDL32a | XbaI, SacI | Fwd Nested: BDL32a_ORF_NF_XbaI-AATCTAGAGAGGATAATGCGTAACACACAAG | 1001 |
| | | Fwd External: BDL32a_ORF_EF_XbaI-AATCTAGAGATTTTATTCGAGGATAATGCG | 1002 |
| | | Rev Nested: BDL32a + b_ORF_NR_SacI-AGAGCTCCATTAAGACATCCGATTTATTTG | 1003 |
| | | Rev External: BDL32a + b_ORF_ER_SacI-AGAGCTCGAGACTTGTCACACACGTGAGG | 1004 |
| BDL32b | XbaI, SacI | Fwd nested: BDL32b_ORF_NF_XbaI-AATCTAGACACACACACAAACATAAGGAAA | 1005 |
| | | Fwd External: BDL32b_ORF_EF_XbaI-AATCTAGAAACAATACACACACACAAACATAAG | 1006 |
| | | Rev Nested: BDL32a + b_ORF_NR_SacI-AGAGCTCCATTAAGACATCCGATTTATTTG | 1007 |
| | | Rev External: BDL32a + b_ORF_ER_SacI-AGAGCTCGAGACTTGTCACACACGTGAGG | 1008 |
| Wrinkled1 | SalI, XbaI | Fwd nested: WRI_NF_ORF_SalI-AATGTCGACCAGAGTTTAATGAAGAAGCGCT | 1009 |
| | | Fwd External: WRI_EF_Art_SalI-AATGTCGACAAATCTAAACTTTCTCAGAG | 1010 |
| | | Rev Nested: WRI_NR_ORF_XbaI-AATCTAGACTCTCTCAGACCAAATAGTTACAAG | 1011 |
| | | Rev External: WRI_ER_Art_XbaI-AATCTAGAGGCAAAGACATTGATTATTC | 1012 |
| Napin | HindIII, SalI | Fwd: Napin F HindIII-ATAAGCTTATTGATTCCTTTAAAGACTTATGTT | 1013 |
| | | Rev: Napin R SalI-TCGTCGACGGGTGTATGTTTTTAATCTTGTTT | 1014 |

To optimize the coding sequence (in silico design), codon-usage Tables calculated from plant transcriptoms were used (example of such Tables can be found in the Codon Usage Database available online at Hypertext Transfer Protocol://World Wide Web (dot) kazusa (dot) or (dot) jp/codon/). The optimized coding sequences were designed in a way that no changes are introduced in the encoded amino acid sequence (of selected polypeptides from Table 1, Example 1) while using codons preferred for expression in dicotyledonous plants mainly *Arabidopsis*, Canola and Soya; and monocotyledonous plants such as maize. Such optimized sequences promote better translation rate and therefore higher protein expression levels. To the optimized sequences flanking additional unique restriction enzymes sites were added-SalI, XbaI, BamHI, SmaI at the 5' end and Sad at the 3' end (except one gene-BDL-1, in which the SmaI site was excluded). The genes for which codon optimized synthetic (artificial) sequences were prepared are: BDL-1 (SEQ ID NO:1040), BDL-4 (SEQ ID NO:1041), BDL-11 (SEQ ID NO:1042), BDL-17 (SEQ ID NO:1043), BDL-20b (SEQ ID NO:1044), BDL-24 (SEQ ID NO:1045), BDL-30 (SEQ ID NO:1046). The artificial optimized polynucleotide sequences were synthesized by a commercial supplier [GeneArt, GmbH, (Hypertext Transfer Protocol://World Wide Web (dot) geneart (dot) com/)].

Generation of Binary Vectors Comprising BDL Genes and Plant Functional Promoters for Driving Expression of Same The plasmid pPI was constructed by inserting a synthetic poly-(A) signal sequence, originating from pGL3 basic plasmid vector (Promega, Acc No U47295; by 4658-4811) into the HindIII restriction site of the binary vector pBI101.3 (Clontech, GenBank Accession. No. U12640). In some cases the backbone binary plasmid used was pGI which is similar to pPI but the GUS gene was replaced by the GUS-Intron gene (Vancanneyt. G, et al MGG 220, 245-50, 1990). pGI was used to clone part of the polynucleotide sequences, initially under the control of 35S promoter [Odell, J T, et al. Nature 313, 810-812 (28 Feb. 1985); SEQ ID NO:921]. Additional sequences were cloned into pMBLArt under the control of 35S promoter.

Some polynucleotide sequences were cloned under other preferential promoter as described below. The promoter, named Napin originated from *Brassica napus* which is characterized by a seed specific promoter activity [Stuitje A. R. et. al. Plant Biotechnology Journal 1 (4): 301-309], was amplified by direct PCR on genomic DNA extracted from leaf tissue using the DNAeasy kit (Qiagen Cat. No. 69104) using the following primers:

```
Napin F Hind III (Enzyme HindII)-
                              (SEQ ID NO: 1013)
5'-ATAAGCTTATTGATTCCTTTAAAGACTTATGTT

Napin R Sal I (Enzyne Sal I)-
                              (SEQ ID NO: 1014)
5'-TCGTCGACGGGTGTATGTTTTTAATCTTGTTT.
```

The following genes were cloned downstream of the Napin promoter sequence: BDL-2, BDL-3, BDL-4, BDL-6, BDL-12, BDL-14, BDL-15, BDL-17, BDL-18, BDL-21, BDL-23, BDL-25, BDL-27, BDL-28, BDL-29, BDL-32b, Wrinkle1. For control purposes, the β-glucuronidase enzyme (GUS, SEQ ID NO:1051) encoded by the uid A gene (GUS-Intron, SEQ ID NO:1049).

Example 4

Producing Transgenic *Arabidopsis* Plants Expressing the Seed Oil Genes

Materials and Methods

Plant transformation was performed according to (Clough S J, Bent A F. 1998. Floral dip: a simplified method for *Agrobacterium*-mediated transformation of *Arabidopsis thaliana*. Plant J. 16(6): 735-43, Desfeux C, Clough S J, Bent A F. 2000. Female reproductive tissues are the primary targets of *Agrobacterium*-mediated transformation by the *Arabidopsis* floral-dip method. Plant Physiol. 123(3): 895-904.).

The *Arabidopsis thaliana* var Columbia ($T_0$ plants) were transformed according to the Floral Dip procedure described by Clough S J, Bent A F. (1998) Floral dip: a simplified method for *Agrobacterium*-mediated transformation of *Arabidopsis thaliana*. Plant J. 16(6): 735-43; and Desfeux C, Clough S J, Bent A F. (20000 Female reproductive tissues are the primary targets of *Agrobacterium*-mediated transformation by the *Arabidopsis* floral-dip method. Plant Physiol. 123(3): 895-904) with minor modifications. Briefly, *Arabidopsis thaliana* Columbia (Col0) $T_0$ Plants were sown in 250 ml pots filled with wet peat-based growth mix. The pots were covered with aluminum foil and a plastic dome, kept at 4° C. for 3-4 days, then uncovered and incubated in a growth chamber at 18-24° C. under 16/8 hours light/dark cycles. The $T_0$ plants were ready for transformation six days before anthesis.

Single colonies of *Agrobacterium* carrying the binary vectors harboring the seed oil genes were cultured in LB medium supplemented with kanamycin (50 mg/L) and gentamycin (50 mg/L). The cultures were incubated at 28° C. for 48 hours under vigorous shaking and centrifuged at 4000 rpm for 5 minutes. The pellets comprising *Agrobacterium* cells were resuspended in a transformation medium which contained half-strength (2.15 g/L) Murashige-Skoog (Duchefa); 0.044 μM benzylamino purine (Sigma); 112 μg/L B5 Gambourg vitamins (Sigma); 5% sucrose; and 0.2 ml/L Silwet L-77 (OSI Specialists, CT) in double-distilled water, at pH of 5.7.

Transformation of $T_0$ plants was performed by inverting each plant into an *Agrobacterium* suspension such that the above ground plant tissue was submerged for 3-5 seconds. Each inoculated $T_0$ plant was immediately placed in a plastic tray, then covered with clear plastic dome to maintain humidity and kept in the dark at room temperature for 18 hours to facilitate infection and transformation. Transformed (transgenic) plants were then uncovered and transferred to a greenhouse for recovery and maturation. The transgenic $T_0$ plants were grown in the greenhouse for 3-5 weeks until siliques were brown and dry, then seeds were harvested from plants and kept at room temperature until sowing For generating $T_1$ and $T_2$ transgenic plants harboring the genes, seeds collected from transgenic $T_0$ plants were surface-sterilized by soaking in 70% ethanol for 1 minute, followed by soaking in 5% sodium hypochlorite and 0.05% triton for 5 minutes. The surface-sterilized seeds were thoroughly washed in sterile distilled water then placed on culture plates containing half-strength Murashig-Skoog (Duchefa); 2% sucrose; 0.8% plant agar; 50 mM kanamycin; and 200 mM carbenicylin (Duchefa). The culture plates were incubated at 4° C. for 48 hours then transferred to a growth room at 25° C. for an additional week of incubation. Vital $T_1$ *Arabidopsis* plants were transferred to a fresh culture plates for another week of incubation. Following incubation the $T_1$ plants were removed from culture plates and planted in growth mix contained in 250 ml pots. The transgenic plants were allowed to grow in a greenhouse to maturity. Seeds harvested from $T_1$ plants were cultured and grown to maturity as $T_2$ plants under the same conditions as used for culturing and growing the $T_1$ plants.

Example 5

Identification of Additional Sequences with Highest Probability to Confer Similar Favorable Effects in the Transgenic Plants Methods for the search and identification of homologues of seed yield polypeptide or polynucleotide would be well within the realm of a person skilled in the art. The search and identification of homologous genes involves the screening of sequence information available, for example, in public databases, that include but are not limited to the DNA Database of Japan (DDBJ), Genbank, and the European Molecular Biology Laboratory Nucleic Acid Sequence Database (EMBL) or versions thereof or the MIPS database. A number of different search algorithms have been developed, including but not limited to the suite of programs referred to as BLAST programs. There are five implementations of BLAST, three designed for nucleotide sequence queries (BLASTN, BLASTX, and TBLASTX) and two designed for protein sequence queries (BLASTP and TBLASTN) (Coulson, Trends in Biotechnology: 76-80, 1994; Birren et al., Genome Analysis, I: 543, 1997). Such methods involve alignment and comparison of sequences. The BLAST algorithm calculates percent sequence identity and performs a statistical analysis of the similarity between the two sequences. The software for performing BLAST analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis one may use standard programs for multiple alignments e.g. Clustal W. A neighbour-joining tree of the proteins homologous to the genes in this invention may be used to provide an overview of structural and ancestral relationships. Sequence identity may be calculated using an alignment program as described above. It is expected that other plants will carry a similar functional gene (orthologue) or a family of similar genes and those genes will provide the same preferred phenotype as the genes presented here. Advantageously, these family members may be useful in the methods of the invention. Example of other plants are included here but not limited to, barley (*Hordeum vulgare*), *Arabidopsis* (*Arabidopsis thaliana*), maize (*Zea mays*), cotton (*Gossypium*), Oilseed rape (*Brassica napus*), Rice (*Oryza sativa*), Sugar cane (*Saccharum officinarum*), *Sorghum* (*Sorghum bicolor*), Soybean (*Glycine max*), Sunflower (*Helianthus annuus*), Tomato (*Lycopersicon esculentum*), Wheat (*Triticum aestivum*)

The above-mentioned analyses for sequence homology is preferably carried out on a full-length sequence, but may also be based on a comparison of certain regions such as conserved domains. The identification of such domains, would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (Hypertext Transfer Protocol://World Wide Web (dot) biochem (dot) ucl (dot) ac (dot) uk/bsm/dbbrowser/protocol/prodomqry (dot) html), PIR (Hypertext Transfer Protocol://pir (dot) Georgetown (dot) edu/) or Pfam (Hypertext Transfer Protocol://World Wide Web (dot) sanger (dot) ac (dot) uk/Software/Pfam/) database. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass, peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break a-helical structures or 3-sheet structures). Conservative substitution tables are well known in the art (see for example Creighton (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Genes identified in publicly available sequence databases as sharing high sequence homology to the *arabidopsis* genes identified herein are summarized in Table 18 below. Those genes are expected to possess similar functions when exogenously introduced into plants, as the *arabidopsis* genes identified. Homolog genes sequences are also provided.

TABLE 18

Table 18
Polypeptides and polynucleotides encoding same which share high sequence homology to the identified *arabidopsis* polypeptides of the invention

| | Polynucleotide SEQ_ID_NO: | Polypeptide SEQ_ID_NO: | Organism | Homology to SEQ_ID_NO: | % identity | % query coverage | Algorithm |
|---|---|---|---|---|---|---|---|
| 1 | 369 | 523 | peanut | 51 | 83 | 48.4 | tblastx |
| 2 | 370 | | oil_palm | 126 | 78 | 19.0 | tblastx |
| 3 | 371 | 524 | tobacco | 51 | 88 | 45.1 | tblastx |
| 4 | 372 | 525 | tobacco | 18 | 85 | 22.0 | tblastx |
| 5 | 373 | 526 | tobacco | 165 | 85 | 13.2 | tblastx |
| 6 | 374 | 527 | tobacco | 165 | 77 | 14.7 | tblastx |
| 7 | 375 | 528 | barley | 51 | 85 | 45.1 | tblastx |
| 8 | 376 | 529 | barley | 117 | 85 | 27.6 | tblastx |
| 9 | 377 | 530 | barley | 126 | 85 | 31.5 | tblastx |
| 10 | 378 | 531 | barley | 137 | 92 | 25.4 | tblastx |
| 11 | 379 | 532 | barley | 150 | 65 | 41.0 | tblastx |
| 12 | 380 | 533 | peach | 51 | 90 | 46.4 | tblastx |
| 13 | 381 | | *thellungiella* | 42 | 86 | 18.9 | tblastx |
| 14 | 382 | | *thellungiella* | 61 | 88 | 13.1 | tblastx |
| 15 | 383 | 534 | *thellungiella* | 66 | 91 | 14.7 | tblastx |
| 16 | 384 | | *thellungiella* | 70 | 86 | 20.5 | tblastx |
| 17 | 385 | 535 | *thellungiella* | 18 | 95 | 26.4 | tblastx |
| 18 | 386 | 536 | *thellungiella* | 163 | 92 | 27.7 | tblastx |
| 19 | 387 | 537 | strawberry | 51 | 83 | 47.1 | tblastx |
| 20 | 388 | 538 | canola | 36 | 90 | 28.5 | tblastx |
| 21 | 389 | | canola | 36 | 88 | 17.0 | tblastx |
| 22 | 390 | 539 | canola | 9 | 89 | 64.7 | tblastx |
| 23 | 391 | 540 | canola | 29 | 88 | 49.9 | tblastx |
| 24 | 392 | 541 | canola | 40 | 87 | 82.0 | tblastx |
| 25 | 393 | 542 | canola | 40 | 87 | 79.4 | tblastx |
| 26 | 394 | 543 | canola | 40 | 87 | 82.0 | tblastx |
| 27 | 395 | | canola | 40 | 86 | 46.5 | tblastx |
| 28 | 396 | 544 | canola | 41 | 95 | 36.5 | tblastx |
| 29 | 397 | 545 | canola | 41 | 93 | 36.5 | tblastx |
| 30 | 398 | 546 | canola | 44 | 87 | 41.1 | tblastx |
| 31 | 399 | 547 | canola | 51 | 93 | 49.0 | tblastx |
| 32 | 400 | 548 | canola | 51 | 97 | 51.0 | tblastx |

TABLE 18-continued

Table 18
Polypeptides and polynucleotides encoding same which share high sequence homology to the identified *arabidopsis* polypeptides of the invention

| | Polynucleotide SEQ_ID_NO: | Polypeptide SEQ_ID_NO: | Organism | Homology to SEQ_ID_NO: | % identity | % query coverage | Algorithm |
|---|---|---|---|---|---|---|---|
| 33 | 401 | 549 | canola | 51 | 77 | 64.7 | tblastx |
| 34 | 402 | 550 | canola | 54 | 94 | 22.3 | tblastx |
| 35 | 403 | 551 | canola | 55 | 93 | 59.3 | tblastx |
| 36 | 404 | | canola | 56 | 85 | 26.0 | tblastx |
| 37 | 405 | 552 | canola | 57 | 94 | 19.1 | tblastx |
| 38 | 406 | 553 | canola | 60 | 90 | 23.6 | tblastx |
| 39 | 407 | 554 | canola | 61 | 88 | 27.7 | tblastx |
| 40 | 408 | 555 | canola | 63 | 92 | 47.5 | tblastx |
| 41 | 409 | 556 | canola | 10 | 87 | 49.7 | tblastx |
| 42 | 410 | 557 | canola | 66 | 91 | 24.9 | tblastx |
| 43 | 411 | | canola | 7 | 87 | 31.6 | tblastx |
| 44 | 412 | | canola | 14 | 92 | 44.1 | tblastx |
| 45 | 413 | | canola | 14 | 92 | 44.1 | tblastx |
| 46 | 414 | | canola | 81 | 85 | 36.3 | tblastx |
| 47 | 415 | 558 | canola | 35 | 90 | 32.4 | tblastx |
| 48 | 416 | 559 | canola | 35 | 88 | 45.3 | tblastx |
| 49 | 417 | 560 | canola | 35 | 91 | 45.3 | tblastx |
| 50 | 418 | 561 | canola | 91 | 88 | 28.9 | tblastx |
| 51 | 419 | 562 | canola | 93 | 95 | 14.5 | tblastx |
| 52 | 420 | | canola | 101 | 95 | 11.3 | tblastx |
| 53 | 421 | 563 | canola | 106 | 84 | 32.1 | tblastx |
| 54 | 422 | | canola | 107 | 83 | 62.3 | tblastx |
| 55 | 423 | 564 | canola | 108 | 94 | 14.4 | tblastx |
| 56 | 424 | 565 | canola | 118 | 90 | 20.6 | tblastx |
| 57 | 425 | 566 | canola | 118 | 95 | 34.4 | tblastx |
| 58 | 426 | 567 | canola | 118 | 95 | 34.4 | tblastx |
| 59 | 427 | 568 | canola | 119 | 83 | 57.2 | tblastx |
| 60 | 428 | | canola | 125 | 84 | 28.1 | tblastx |
| 61 | 429 | | canola | 135 | 96 | 24.6 | tblastx |
| 62 | 430 | 569 | canola | 137 | 90 | 32.7 | tblastx |
| 63 | 431 | | canola | 18 | 93 | 33.4 | tblastx |
| 64 | 432 | 570 | canola | 21 | 84 | 83.9 | tblastx |
| 65 | 433 | | canola | 140 | 92 | 52.2 | tblastx |
| 66 | 434 | 571 | canola | 143 | 92 | 41.7 | tblastx |
| 67 | 435 | 572 | canola | 143 | 93 | 41.0 | tblastx |
| 68 | 436 | 573 | canola | 145 | 89 | 49.1 | tblastx |
| 69 | 437 | 574 | canola | 145 | 91 | 39.8 | tblastx |
| 70 | 438 | | canola | 153 | 94 | 26.4 | tblastx |
| 71 | 439 | 575 | canola | 160 | 89 | 79.6 | tblastx |
| 72 | 440 | 576 | canola | 163 | 91 | 27.7 | tblastx |
| 73 | 441 | 577 | canola | 164 | 80 | 76.6 | tblastx |
| 74 | 442 | 578 | canola | 165 | 85 | 11.9 | tblastx |
| 75 | 443 | 579 | melon | 51 | 84 | 47.1 | tblastx |
| 76 | 444 | 580 | sugarcane | 137 | 90 | 25.7 | tblastx |
| 77 | 445 | 581 | sugarcane | 137 | 88 | 28.4 | tblastx |
| 78 | 446 | 582 | b_rapa | 41 | 95 | 36.1 | tblastx |
| 79 | 447 | 583 | b_rapa | 57 | 92 | 9.5 | tblastx |
| 80 | 448 | | b_rapa | 64 | 86 | 45.7 | tblastx |
| 81 | 449 | 584 | b_rapa | 10 | 84 | 39.0 | tblastx |
| 82 | 450 | | b_rapa | 4 | 86 | 40.5 | tblastx |
| 83 | 451 | 585 | b_rapa | 35 | 86 | 17.2 | tblastx |
| 84 | 452 | 586 | b_rapa | 106 | 78 | 36.8 | tblastx |
| 85 | 453 | 587 | b_rapa | 122 | 94 | 71.4 | tblastx |
| 86 | 454 | 588 | b_rapa | 126 | 87 | 32.6 | tblastx |
| 87 | 455 | 589 | b_rapa | 135 | 86 | 41.7 | tblastx |
| 88 | 456 | 590 | b_rapa | 137 | 85 | 17.8 | tblastx |
| 89 | 457 | 591 | b_rapa | 18 | 94 | 26.0 | tblastx |
| 90 | 458 | 592 | b_rapa | 150 | 82 | 42.9 | tblastx |
| 91 | 459 | | b_rapa | 152 | 88 | 32.6 | tblastx |
| 92 | 460 | 593 | b_rapa | 165 | 85 | 11.9 | tblastx |
| 93 | 461 | 594 | maize | 137 | 86 | 24.1 | tblastx |
| 94 | 462 | 595 | maize | 137 | 89 | 14.0 | tblastx |
| 95 | 463 | 596 | maize | 137 | 86 | 24.1 | tblastx |
| 96 | 464 | 597 | maize | 165 | 72 | 15.5 | tblastx |
| 97 | 465 | 598 | almond | 18 | 89 | 20.8 | tblastx |
| 98 | 466 | 599 | *sorghum* | 123 | 87 | 20.6 | tblastx |
| 99 | 466 | 599 | *sorghum* | 124 | 87 | 20.5 | tblastx |
| 100 | 467 | 600 | *sorghum* | 123 | 89 | 19.8 | tblastx |
| 101 | 467 | 600 | *sorghum* | 124 | 89 | 19.6 | tblastx |
| 102 | 468 | 601 | *sorghum* | 137 | 85 | 12.6 | tblastx |
| 103 | 469 | | soybean | 126 | 97 | 22.4 | tblastx |
| 104 | 470 | 602 | soybean | 137 | 92 | 20.1 | tblastx |
| 105 | 471 | 603 | soybean | 137 | 92 | 11.2 | tblastx |

TABLE 18-continued

Table 18
Polypeptides and polynucleotides encoding same which share high sequence homology to the identified *arabidopsis* polypeptides of the invention

| | Polynucleotide SEQ_ID_NO: | Polypeptide SEQ_ID_NO: | Organism | Homology to SEQ_ID_NO: | % identity | % query coverage | Algorithm |
|---|---|---|---|---|---|---|---|
| 106 | 472 | 604 | soybean | 137 | 92 | 20.1 | tblastx |
| 107 | 473 | 605 | soybean | 137 | 85 | 13.1 | tblastx |
| 108 | 474 | 606 | soybean | 137 | 87 | 17.0 | tblastx |
| 109 | 475 | 607 | soybean | 137 | 92 | 11.2 | tblastx |
| 110 | 476 | 608 | soybean | 137 | 85 | 32.3 | tblastx |
| 111 | 477 | 609 | soybean | 18 | 85 | 28.0 | tblastx |
| 112 | 478 | 610 | soybean | 18 | 86 | 28.0 | tblastx |
| 113 | 479 | 611 | soybean | 150 | 86 | 52.8 | tblastx |
| 114 | 480 | 612 | soybean | 150 | 86 | 52.8 | tblastx |
| 115 | 481 | 613 | soybean | 150 | 86 | 52.8 | tblastx |
| 116 | 482 | 614 | rice | 137 | 92 | 23.6 | tblastx |
| 117 | 483 | 615 | rice | 137 | 93 | 20.6 | tblastx |
| 118 | 484 | 616 | rice | 137 | 95 | 23.6 | tblastx |
| 119 | 485 | 617 | sunflower | 150 | 83 | 44.0 | tblastx |
| 120 | 486 | | sunflower | 161 | 90 | 7.8 | tblastx |
| 121 | 487 | 618 | poplar | 51 | 85 | 45.1 | tblastx |
| 122 | 488 | 619 | poplar | 123 | 89 | 22.6 | tblastx |
| 123 | 488 | 619 | poplar | 124 | 89 | 22.5 | tblastx |
| 124 | 489 | 620 | poplar | 137 | 87 | 8.3 | tblastx |
| 125 | 490 | 621 | poplar | 18 | 86 | 15.8 | tblastx |
| 126 | 491 | 622 | poplar | 165 | 85 | 13.2 | tblastx |
| 127 | 492 | | b_oleracea | 29 | 92 | 23.3 | tblastx |
| 128 | 493 | | b_oleracea | 50 | 90 | 20.7 | tblastx |
| 129 | 494 | 623 | b_oleracea | 51 | 93 | 51.6 | tblastx |
| 130 | 495 | 624 | b_oleracea | 55 | 91 | 43.7 | tblastx |
| 131 | 496 | | b_oleracea | 107 | 84 | 62.3 | tblastx |
| 132 | 497 | 625 | b_oleracea | 126 | 88 | 32.6 | tblastx |
| 133 | 498 | 626 | b_oleracea | 136 | 85 | 45.0 | tblastx |
| 134 | 499 | 627 | b_oleracea | 136 | 87 | 75.3 | tblastx |
| 135 | 500 | 628 | grape | 51 | 87 | 46.4 | tblastx |
| 136 | 501 | | grape | 4 | 84 | 23.5 | tblastx |
| 137 | 502 | 629 | grape | 143 | 90 | 21.9 | tblastx |
| 138 | 503 | 630 | grape | 150 | 93 | 21.4 | tblastx |
| 139 | 504 | 631 | grape | 150 | 84 | 39.5 | tblastx |
| 140 | 505 | 632 | wheat | 123 | 92 | 14.9 | tblastx |
| 141 | 505 | 632 | wheat | 124 | 92 | 14.8 | tblastx |
| 142 | 506 | 633 | wheat | 126 | 82 | 32.9 | tblastx |
| 143 | 507 | 634 | wheat | 126 | 87 | 28.0 | tblastx |
| 144 | 508 | 635 | wheat | 126 | 83 | 32.1 | tblastx |
| 145 | 509 | 636 | wheat | 137 | 91 | 24.1 | tblastx |
| 146 | 510 | 637 | wheat | 137 | 89 | 32.3 | tblastx |
| 147 | 511 | 638 | wheat | 137 | 95 | 11.2 | tblastx |
| 148 | 512 | 639 | wheat | 150 | 73 | 53.9 | tblastx |
| 149 | 513 | 640 | wheat | 161 | 86 | 8.8 | tblastx |
| 150 | 514 | 641 | wheat | 161 | 88 | 7.8 | tblastx |
| 151 | 515 | 642 | wheat | 161 | 92 | 7.2 | tblastx |
| 152 | 516 | 643 | flax | 18 | 74 | 15.3 | tblastx |
| 153 | 517 | 644 | tomato | 51 | 85 | 45.8 | tblastx |
| 154 | 518 | 645 | tomato | 123 | 92 | 15.9 | tblastx |
| 155 | 518 | 645 | tomato | 124 | 92 | 15.8 | tblastx |
| 156 | 519 | 646 | tomato | 126 | 94 | 25.1 | tblastx |
| 157 | 520 | 647 | cotton | 51 | 87 | 45.8 | tblastx |
| 158 | 521 | 648 | cotton | 51 | 88 | 46.4 | tblastx |
| 159 | 522 | 649 | cotton | 123 | 91 | 18.8 | tblastx |
| 160 | 522 | 649 | cotton | 124 | 91 | 18.7 | tblastx |
| 161 | 650 | 786 | b_rapa | 169 | 88 | 73.7 | blastp |
| 162 | 651 | 787 | canola | 169 | 93 | 62.6 | blastp |
| 163 | 652 | 788 | radish | 169 | 88 | 77.1 | blastp |
| 164 | 653 | 789 | b_oleracea | 174 | 93 | 55.7 | blastp |
| 165 | 654 | 790 | b_rapa | 179 | 94 | 70.4 | blastp |
| 166 | 655 | 791 | canola | 179 | 88 | 100.0 | blastp |
| 167 | 656 | 792 | canola | 183 | 85 | 84.9 | blastp |
| 168 | 657 | 793 | canola | 186 | 89 | 96.8 | blastp |
| 169 | 658 | 794 | canola | 191 | 89 | 51.4 | blastp |
| 170 | 659 | 795 | b_oleracea | 192 | 88 | 56.4 | blastp |
| 171 | 660 | 796 | canola | 194 | 85 | 96.0 | blastp |
| 172 | 661 | 797 | b_rapa | 195 | 90 | 100.0 | blastp |
| 173 | 662 | 798 | canola | 195 | 91 | 100.0 | blastp |
| 174 | 663 | 799 | canola | 200 | 90 | 94.7 | blastp |
| 175 | 664 | 800 | canola | 200 | 90 | 98.9 | blastp |
| 176 | 665 | 801 | b_oleracea | 205 | 87 | 100.0 | blastp |
| 177 | 666 | 802 | b_rapa | 205 | 87 | 69.1 | blastp |
| 178 | 667 | 803 | b_rapa | 205 | 86 | 73.5 | blastp |

TABLE 18-continued

Table 18
Polypeptides and polynucleotides encoding same which share high sequence homology to the identified *arabidopsis* polypeptides of the invention

| | Polynucleotide SEQ_ID_NO: | Polypeptide SEQ_ID_NO: | Organism | Homology to SEQ_ID_NO: | % identity | % query coverage | Algorithm |
|---|---|---|---|---|---|---|---|
| 179 | 668 | 804 | canola | 205 | 86 | 61.4 | blastp |
| 180 | 669 | 805 | radish | 205 | 87 | 76.5 | blastp |
| 181 | 670 | 806 | canola | 206 | 93 | 100.0 | blastp |
| 182 | 671 | 807 | radish | 206 | 93 | 100.0 | blastp |
| 183 | 672 | 808 | b_oleracea | 209 | 87 | 52.6 | blastp |
| 184 | 673 | 809 | b_rapa | 209 | 86 | 51.9 | blastp |
| 185 | 674 | 810 | canola | 209 | 88 | 100.0 | blastp |
| 186 | 675 | 811 | apple | 216 | 89 | 100.0 | blastp |
| 187 | 676 | 812 | apple | 216 | 89 | 100.0 | blastp |
| 188 | 677 | 813 | avocado | 216 | 85 | 100.0 | blastp |
| 189 | 678 | 814 | b_juncea | 216 | 97 | 69.1 | blastp |
| 190 | 679 | 815 | b_juncea | 216 | 98 | 91.2 | blastp |
| 191 | 680 | 816 | b_juncea | 216 | 97 | 100.0 | blastp |
| 192 | 681 | 817 | b_rapa | 216 | 97 | 100.0 | blastp |
| 193 | 682 | 818 | bean | 216 | 88 | 100.0 | blastp |
| 194 | 683 | 819 | *brachypodium* | 216 | 85 | 100.0 | blastp |
| 195 | 684 | 820 | cassava | 216 | 91 | 100.0 | blastp |
| 196 | 685 | 821 | cassava | 216 | 86 | 100.0 | blastp |
| 197 | 686 | 822 | castorbean | 216 | 88 | 100.0 | blastp |
| 198 | 687 | 823 | centaurea | 216 | 86 | 100.0 | blastp |
| 199 | 688 | 824 | centaurea | 216 | 86 | 100.0 | blastp |
| 200 | 689 | 825 | citrus | 216 | 89 | 100.0 | blastp |
| 201 | 690 | 826 | citrus | 216 | 89 | 100.0 | blastp |
| 202 | 691 | 827 | *coffea* | 216 | 85 | 100.0 | blastp |
| 203 | 692 | 828 | cotton | 216 | 88 | 100.0 | blastp |
| 204 | 693 | 829 | iceplant | 216 | 86 | 100.0 | blastp |
| 205 | 694 | 830 | *ipomoea* | 216 | 88 | 100.0 | blastp |
| 206 | 695 | 831 | lettuce | 216 | 85 | 100.0 | blastp |
| 207 | 696 | 832 | lettuce | 216 | 85 | 100.0 | blastp |
| 208 | 697 | 833 | lettuce | 216 | 85 | 100.0 | blastp |
| 209 | 698 | 834 | lettuce | 216 | 85 | 100.0 | blastp |
| 210 | 699 | 835 | *lotus* | 216 | 89 | 100.0 | blastp |
| 211 | 700 | 836 | *medicago* | 216 | 88 | 100.0 | blastp |
| 212 | 701 | 837 | pepper | 216 | 86 | 100.0 | blastp |
| 213 | 702 | 838 | periwinkle | 216 | 88 | 100.0 | blastp |
| 214 | 703 | 839 | *petunia* | 216 | 88 | 100.0 | blastp |
| 215 | 704 | 840 | potato | 216 | 86 | 97.1 | blastp |
| 216 | 705 | 841 | radish | 216 | 95 | 100.0 | blastp |
| 217 | 706 | 842 | radish | 216 | 95 | 100.0 | blastp |
| 218 | 707 | 843 | radish | 216 | 97 | 100.0 | blastp |
| 219 | 708 | 844 | rose | 216 | 85 | 100.0 | blastp |
| 220 | 709 | 845 | safflower | 216 | 85 | 100.0 | blastp |
| 221 | 710 | 846 | safflower | 216 | 85 | 100.0 | blastp |
| 222 | 711 | 847 | safflower | 216 | 86 | 100.0 | blastp |
| 223 | 712 | 848 | soybean | 216 | 91 | 100.0 | blastp |
| 224 | 713 | 849 | soybean | 216 | 91 | 100.0 | blastp |
| 225 | 714 | 850 | spurge | 216 | 89 | 97.1 | blastp |
| 226 | 715 | 851 | strawberry | 216 | 86 | 100.0 | blastp |
| 227 | 716 | | *thellungiella* | 216 | 90 | 92.6 | tblastn |
| 228 | 717 | 852 | tobacco | 216 | 88 | 100.0 | blastp |
| 229 | 718 | 853 | radish | 219 | 87 | 100.0 | blastp |
| 230 | 719 | 854 | radish | 219 | 92 | 54.8 | blastp |
| 231 | 720 | 855 | b_oleracea | 220 | 93 | 70.8 | blastp |
| 232 | 721 | 856 | b_rapa | 220 | 93 | 99.1 | blastp |
| 233 | 722 | 857 | canola | 220 | 93 | 81.5 | blastp |
| 234 | 723 | 858 | radish | 220 | 93 | 99.1 | blastp |
| 235 | 724 | 859 | radish | 220 | 93 | 99.4 | blastp |
| 236 | 725 | 860 | *arabidopsis* | 244 | 96 | 99.6 | blastp |
| 237 | 726 | 861 | *arabidopsis* | 244 | 96 | 99.3 | tblastn |
| 238 | 727 | 862 | b_rapa | 246 | 86 | 52.1 | blastp |
| 239 | 728 | 863 | canola | 246 | 85 | 53.4 | blastp |
| 240 | 729 | 864 | canola | 258 | 87 | 100.0 | blastp |
| 241 | 730 | 865 | canola | 266 | 86 | 51.5 | blastp |
| 242 | 731 | 866 | b_oleracea | 272 | 85 | 97.1 | blastp |
| 243 | 732 | 867 | canola | 272 | 85 | 97.1 | blastp |
| 244 | 733 | 868 | *arabidopsis* | 273 | 87 | 99.0 | blastp |
| 245 | 734 | 869 | b_rapa | 273 | 94 | 81.1 | blastp |
| 246 | 735 | 870 | b_rapa | 273 | 88 | 60.8 | blastp |
| 247 | 736 | 871 | b_rapa | 273 | 94 | 65.2 | blastp |
| 248 | 737 | 872 | radish | 273 | 89 | 75.4 | blastp |
| 249 | 738 | 873 | b_rapa | 274 | 86 | 81.0 | blastp |
| 250 | 739 | 874 | canola | 274 | 90 | 100.0 | blastp |
| 251 | 740 | 875 | *arabidopsis* | 277 | 85 | 57.7 | blastp |

TABLE 18-continued

Table 18
Polypeptides and polynucleotides encoding same which share high sequence homology to the identified *arabidopsis* polypeptides of the invention

| | Polynucleotide SEQ_ID_NO: | Polypeptide SEQ_ID_NO: | Organism | Homology to SEQ_ID_NO: | % identity | % query coverage | Algorithm |
|---|---|---|---|---|---|---|---|
| 252 | 741 | 876 | canola | 277 | 90 | 92.8 | blastp |
| 253 | 742 | 877 | radish | 277 | 88 | 99.1 | blastp |
| 254 | 743 | 878 | b_oleracea | 282 | 87 | 75.2 | blastp |
| 255 | 744 | 879 | b_rapa | 283 | 94 | 74.6 | blastp |
| 256 | 745 | 880 | *basilicum* | 283 | 85 | 51.7 | blastp |
| 257 | 746 | 881 | canola | 283 | 90 | 58.1 | blastp |
| 258 | 747 | 882 | canola | 284 | 85 | 100.0 | blastp |
| 259 | 748 | 883 | *arabidopsis* | 286 | 88 | 54.1 | blastp |
| 260 | 749 | 884 | *arabidopsis* | 286 | 86 | 98.2 | blastp |
| 261 | 750 | 885 | b_rapa | 286 | 85 | 59.2 | blastp |
| 262 | 751 | 886 | radish | 287 | 91 | 100.0 | blastp |
| 263 | 752 | 887 | *thellungiella* | 287 | 93 | 94.7 | blastp |
| 264 | 753 | 888 | canola | 288 | 92 | 60.4 | blastp |
| 265 | 754 | 889 | b_oleracea | 297 | 86 | 96.1 | blastp |
| 266 | 755 | 890 | canola | 297 | 85 | 96.1 | blastp |
| 267 | 756 | 891 | canola | 297 | 86 | 96.1 | blastp |
| 268 | 757 | 892 | b_oleracea | 299 | 85 | 53.2 | blastp |
| 269 | 758 | 893 | canola | 299 | 85 | 100.0 | blastp |
| 270 | 759 | 894 | canola | 299 | 85 | 58.2 | blastp |
| 271 | 760 | 895 | canola | 300 | 94 | 51.9 | blastp |
| 272 | 761 | 896 | b_rapa | 301 | 85 | 98.1 | blastp |
| 273 | 762 | 897 | radish | 301 | 86 | 99.4 | blastp |
| 274 | 763 | 898 | b_rapa | 302 | 85 | 100.0 | blastp |
| 275 | 764 | 899 | canola | 305 | 92 | 87.5 | blastp |
| 276 | 765 | 900 | canola | 305 | 92 | 94.8 | blastp |
| 277 | 766 | 901 | radish | 305 | 92 | 100.0 | blastp |
| 278 | 767 | 902 | b_rapa | 308 | 91 | 62.4 | blastp |
| 279 | 768 | 903 | radish | 308 | 91 | 51.4 | blastp |
| 280 | 769 | 904 | b_rapa | 310 | 94 | 89.1 | blastp |
| 281 | 770 | 905 | canola | 310 | 93 | 99.4 | blastp |
| 282 | 771 | 906 | radish | 310 | 92 | 99.7 | blastp |
| 283 | 772 | 907 | *arabidopsis* | 313 | 91 | 99.8 | blastp |
| 284 | 773 | 908 | b_oleracea | 317 | 93 | 63.9 | blastp |
| 285 | 774 | 909 | canola | 317 | 85 | 100.0 | blastp |
| 286 | 775 | 910 | *arabidopsis* | 318 | 85 | 99.9 | blastp |
| 287 | 776 | 911 | canola | 328 | 85 | 100.0 | blastp |
| 288 | 777 | 912 | b_oleracea | 329 | 93 | 100.0 | blastp |
| 289 | 778 | 913 | b_rapa | 329 | 88 | 100.0 | blastp |
| 290 | 779 | 914 | b_rapa | 329 | 94 | 100.0 | blastp |
| 291 | 780 | 915 | canola | 329 | 88 | 100.0 | blastp |
| 292 | 781 | 916 | canola | 329 | 94 | 100.0 | blastp |
| 293 | 782 | 917 | radish | 329 | 88 | 54.1 | blastp |
| 294 | 783 | 918 | *thellungiella* | 329 | 93 | 88.1 | blastp |
| 295 | 784 | 919 | b_rapa | 354 | 91 | 100.0 | blastp |
| 296 | 785 | 920 | canola | 354 | 89 | 67.7 | blastp |

Example 6

Improved Transgenic Plant Performance

To analyze whether the transgenic plants has performed better, plants were grown in pots with an adequate amount of nutrient and water. The plants were analyzed for their overall size, growth rate, time to inflorescence emergence (bolting) and flowering, seed yield, oil content of seed, weight of 1,000 seeds, dry matter and harvest index (HI-seed yield/dry matter). Transgenic plants performance was compared to control plants grown in parallel under the same conditions. Mock-transgenic plants expressing the uidA reporter gene (GUS-Intron) under the same promoter were used as control.

Parameters were measured as described in Examples 1 and 2.

Statistical Analyses

To identify genes conferring significantly improved plant performance, the results obtained from the transgenic plants were compared to those obtained from control plants. Plant growth rate, plant area, time to bolt, time to flower, weight of 1,000 seeds, seed yield, oil yield, dry matter, and harvest index area data were analyzed using one-way ANOVA. To identify outperforming genes and constructs, results from mix of transformation events or independent events tested were analyzed. For gene versus control analysis T-test was applied, using significance of $p<0.05$. The JMP statistics software package was used (Version 5.2.1, SAS Institute Inc., Cary, N.C., USA).

Experimental Results

The polynucleotide sequences of the invention were assayed for a number of commercially desired traits.

Tables 19-24 depict analyses of seed yield in plants over-expressing the polynucleotides of the invention under the regulation of a constitutive (35S) or seed specific (napin) promoter. Each Table represents an independent experiment, using at least 5 independent events per gene. Genes not connected by same letter as the control (A, B,) are significantly different from the control.

TABLE 19

| Table 19 Genes showing improved plant performance: Seed yield | | | | | |
|---|---|---|---|---|---|
| | | | Seed yield per plant (gr) | | |
| Gene Id | SEQ ID NO: of overexpressed polynucleotide | Under regulation of | Least Sq Mean | Significance (t-Test compare to control) | % improvement |
| BDL8 | 1021 | 35S | 0.264 | A | 15.9 |
| BDL25 | 1032 | 35S | 0.239 | B | 5.2 |
| BDL27 | 1035 | 35S | 0.238 | B | 4.8 |
| BDL29 | 1037 | 35S | 0.235 | B | 3.4 |
| BDL32a | 1038 | 35S | 0.228 | B | 0.4 |
| CONTROL (GUS_Intron) | 1049 | 35S | 0.228 | B | 0.0 |

TABLE 20

| Table 20 Genes showing improved plant performance: Seed yield | | | | | |
|---|---|---|---|---|---|
| | | | Seed yield per plant (gr) | | |
| Gene Id | SEQ ID NO: of overexpressed polynucleotide | Under regulation of | Least Sq Mean | Significance (t-Test compare to control) | % improvement |
| BDL3 | 1017 | 35S | 0.447 | A | 10.9 |
| BDL11 | 1042 | 35S | 0.420 | A | 4.2 |
| BDL17 | 1043 | 35S | 0.426 | A | 5.8 |
| CONTROL (GUS_Intron) | 1049 | 35S | 0.403 | A | 0.0 |

TABLE 21

| Table 21 Genes showing improved plant performance: Seed yield | | | | | |
|---|---|---|---|---|---|
| | | | Seed yield per plant (gr) | | |
| Gene Id | SEQ ID NO: of overexpressed polynucleotide | Under regulation of | Least Sq Mean | Significance (t-Test compare to control) | % improvement |
| BDL3 | 1017 | Napin | 0.492 | A | 13.4 |
| BDL6 | 1019 | Napin | 0.469 | B | 8.1 |
| BDL28 | 1036 | Napin | 0.470 | B | 8.3 |
| CONTROL (GUS_Intron) | 1049 | Napin | 0.434 | B | 0.0 |

TABLE 22

| Table 22 Genes showing improved plant performance: Seed yield | | | | | |
|---|---|---|---|---|---|
| | | | Seed yield per plant (gr) | | |
| Gene Id | SEQ ID NO: of overexpressed polynucleotide | Under regulation of | Least Sq Mean | Significance (t-Test compare to control) | % improvement |
| BDL1 | 1040 | 35S | 0.359 | A | 23.5 |
| BDL12 | 1023 | 35S | 0.319 | B | 9.7 |
| BDL14 | 1024 | 35S | 0.378 | A | 30.3 |
| BDL18 | 1027 | 35S | 0.334 | B | 15.0 |
| BDL20a | 1029 | 35S | 0.325 | B | 12.0 |
| BDL20b | 1044 | 35S | 0.323 | B | 11.4 |
| BDL26a | 1033 | 35S | 0.340 | B | 17.0 |
| BDL26b | 1034 | 35S | 0.318 | B | 9.7 |

TABLE 22-continued

Table 22
Genes showing improved plant performance: Seed yield

| Gene Id | SEQ ID NO: of overexpressed polynucleotide | Under regulation of | Seed yield per plant (gr) Least Sq Mean | Significance (t-Test compare to control) | % improvement |
|---|---|---|---|---|---|
| BDL30 | 1046 | 35S | 0.340 | B | 17.2 |
| CONTROL (GUS_Intron) | 1049 | 35S | 0.290 | B | 0.0 |

TABLE 23

Table 23
Genes showing improved plant performance: Seed yield

| Gene Id | SEQ ID NO: of overexpressed polynucleotide | Under regulation of | Seed yield per plant (gr) Least Sq Mean | Significance (t-Test compare to control) | % improvement |
|---|---|---|---|---|---|
| BDL9 | 1022 | 35S | 0.312 | B | 10.1 |
| BDL27 | 1035 | 35S | 0.320 | A | 13.0 |
| BDL32b | 1039 | 35S | 0.334 | A | 17.8 |
| CONTROL (GUS_Intron) | 1049 | 35S | 0.283 | B | 0.0 |

TABLE 24

Table 24
Genes showing improved plant performance: Seed yield

| Gene Id | SEQ ID NO: of overexpressed polynucleotide | Under regulation of | Seed yield per plant (gr) Least Sq Mean | Significance (t-Test compare to control) | % improvement |
|---|---|---|---|---|---|
| BDL25 | 1032 | Napin | 0.41 | B | 0.1 |
| BDL29 | 1037 | Napin | 0.44 | B | 8.3 |
| BDL32b | 1039 | Napin | 0.46 | A | 13.0 |
| CONTROL (GUS_Intron) | 1049 | Napin | 0.41 | B | 0.0 |

Tables 25-30 depict analyses of oil yield in plants overexpressing the polynucleotides of the invention under the regulation of a constitutive (35S) or seed specific (napin) promoter. Each Table represents an independent experiment, using at least 5 independent events per gene. Genes not connected by same letter as the control (A, B,) are significantly different from the control.

TABLE 25

Table 25
Genes showing improved plant performance: Oil yield

| Gene Id | SEQ ID NO: of overexpressed polynucleotide | Under regulation of | Oil yield per plant (gr) Least Sq Mean | Significance (t-Test compare to control) | % improvement |
|---|---|---|---|---|---|
| BDL8 | 1021 | 35S | 0.080 | A | 17.1 |
| BDL25 | 1032 | 35S | 0.074 | B | 8.3 |
| BDL27 | 1035 | 35S | 0.070 | B | 2.1 |
| BDL32a | 1038 | 35S | 0.069 | B | 1.1 |
| CONTROL (GUS_Intron) | 1049 | 35S | 0.069 | B | 0.0 |

TABLE 26

Table 26
Genes showing improved plant performance: Oil yield

| Gene Id | SEQ ID NO: of overexpressed polynucleotide | Under regulation of | Oil yield per plant (gr) Least Sq Mean | Significance (t-Test compare to control) | % improvement |
|---|---|---|---|---|---|
| BDL3 | 1017 | 35S | 0.13 | A | 13.7 |
| BDL11 | 1042 | 35S | 0.12 | A | 7.0 |
| BDL17 | 1043 | 35S | 0.12 | A | 6.5 |
| CONTROL (GUS_Intron) | 1049 | 35S | 0.12 | A | 0.0 |

TABLE 27

Table 27
Genes showing improved plant performance: Oil yield

| Gene Id | SEQ ID NO: of overexpressed polynucleotide | Under regulation of | Oil yield per plant (gr) Least Sq Mean | Significance (t-Test compare to control) | % improvement |
|---|---|---|---|---|---|
| BDL3 | 1017 | Napin | 0.149 | A | 13.7 |
| BDL6 | 1019 | Napin | 0.143 | B | 9.2 |
| BDL28 | 1036 | Napin | 0.138 | B | 5.3 |
| CONTROL (GUS_Intron) | 1049 | Napin | 0.131 | B | 0.0 |

TABLE 28

Table 28
Genes showing improved plant performance: Oil yield

| Gene Id | SEQ ID NO: of overexpressed polynucleotide | Under regulation of | Oil yield per plant (gr) Least Sq Mean | Significance (t-Test compare to control) | % improvement |
|---|---|---|---|---|---|
| BDL1 | 1040 | 35S | 0.108 | A* | 23.7 |
| BDL12 | 1023 | 35S | 0.100 | B | 14.2 |
| BDL14 | 1024 | 35S | 0.114 | A | 31.1 |
| BDL18 | 1027 | 35S | 0.102 | B | 16.7 |
| BDL20a | 1029 | 35S | 0.098 | B | 12.0 |
| BDL20b | 1044 | 35S | 0.098 | B | 12.1 |
| BDL26a | 1033 | 35S | 0.103 | B | 18.0 |
| BDL26b | 1034 | 35S | 0.097 | B | 11.8 |
| BDL30 | 1046 | 35S | 0.107 | B | 22.4 |
| CONTROL (GUS_Intron) | 1049 | 35S | 0.087 | B | 0.0 |

*P = 0.07

TABLE 29

Table 29
Genes showing improved plant performance: Oil yield

| Gene Id | SEQ ID NO: of overexpressed polynucleotide | Under regulation of | Oil yield per plant (gr) Least Sq Mean | Significance (t-Test compare to control) | % improvement |
|---|---|---|---|---|---|
| BDL9 | 1022 | 35S | 0.092 | B | 6.2 |
| BDL27 | 1035 | 35S | 0.095 | B | 9.1 |
| BDL32b | 1039 | 35S | 0.101 | A | 16.4 |
| CONTROL (GUS_Intron) | 1049 | 35S | 0.087 | B | 0.0 |

TABLE 30

Table 30
Genes showing improved plant performance: Oil yield

| Gene Id | SEQ ID NO: of overexpressed polynucleotide | Under regulation of | Oil yield per plant (gr) Least Sq Mean | Significance (t-Test compare to control) | % improvement |
|---|---|---|---|---|---|
| BDL25 | 1032 | Napin | 0.12 | B | 2.2 |
| BDL29 | 1037 | Napin | 0.14 | A | 15.8 |
| BDL32b | 1039 | Napin | 0.15 | A | 20.6 |
| CONTROL (GUS_Intron) | 1049 | Napin | 0.12 | B | 0.0 |

Tables 31-32 depict analyses of dry matter in plants over-expressing the polynucleotides of the invention under the regulation of a constitutive (35S). Each Table represents an independent experiment, using at least 5 independent events per gene. Genes not connected by same letter as the control (A, B,) are significantly different from the control.

TABLE 31

Table 31
Genes showing improved plant performance: Dry matter

| Gene Id | SEQ ID NO: of over-expressed polynucleotide | Under regulation of | Dry matter per plant (gr) Least Sq Mean | Significance (t-Test compare to control) | % improvement |
|---|---|---|---|---|---|
| BDL6 | 1019 | 35S | 1.0277 | A | 7.9 |
| BDL14 | 1024 | 35S | 1.0444 | A | 9.7 |
| BDL18 | 1027 | 35S | 0.985 | A | 3.4 |
| BDL20b | 1044 | 35S | 1.0656 | A | 11.9 |
| CONTROL (GUS_Intron) | 1049 | 35S | 0.9523 | A | 0.0 |

TABLE 32

Table 32
Genes showing improved plant performance: Dry matter

| Gene Id | SEQ ID NO: of over-expressed poly-nucleotide | Under regula-tion of | Dry matter per plant (gr) Least Sq Mean | Significance (t-Test compare to control) | % im-prove-ment |
|---|---|---|---|---|---|
| BDL3 | 1017 | 35S | 1.3915 | A | 3.3 |
| BDL11 | 1042 | 35S | 1.3638 | A | 1.2 |
| CONTROL (GUS_Intron) | 1049 | 35S | 1.3474 | A | 0.0 |

Tables 33-34 depict analyses of harvest index (HI) in plants overexpressing the polynucleotides of the invention under the regulation of a constitutive (35S) or seed specific (napin) promoter. Each Table represents an independent experiment, using at least 5 independent events per gene. Genes not connected by same letter as the control (A, B,) are significantly different from the control.

TABLE 33

Table 33
Genes showing improved plant performance: harvest index (HI)

| Gene Id | SEQ ID NO: of over-expressed poly-nucleotide | Under regula-tion of | HI Least Sq Mean | Significance (t-Test compare to control) | % im-prove-ment |
|---|---|---|---|---|---|
| BDL3 | 1017 | 35S | 0.3218 | B | 7.2 |
| BDL5 | 1018 | 35S | 0.3094 | B | 3.0 |
| BDL8 | 1021 | 35S | 0.3301 | B | 9.9 |
| BDL11 | 1042 | 35S | 0.3063 | B | 2.0 |
| BDL17 | 1043 | 35S | 0.3526 | A | 17.5 |
| BDL25 | 1032 | 35S | 0.3016 | B | 0.4 |
| CONTROL (GUS_Intron) | 1049 | 35S | 0.3002 | B | 0.0 |

TABLE 34

Table 34
Genes showing improved plant performance: harvest index (HI)

| Gene Id | SEQ ID NO: of overexpressed polynucleotide | Under regula-tion of | HI Least Sq Mean | Significance (t-Test compare to control) | % im-prove-ment |
|---|---|---|---|---|---|
| BDL2 | 1016 | Napin | 0.342 | B | 3.7 |
| BDL3 | 1017 | Napin | 0.358 | B | 8.8 |
| BDL6 | 1019 | Napin | 0.365 | B | 10.9 |
| BDL28 | 1036 | Napin | 0.374 | A | 13.6 |
| CONTROL (GUS_Intron) | 1049 | Napin | 0.329 | B | 0.0 |

Tables 35-38 depict analyses of growth rate in plants overexpressing the polynucleotides of the invention under the regulation of a constitutive ($^{35}$S). Each Table represents an independent experiment, using at least 5 independent events per gene. Genes not connected by same letter as the control (A, B,) are significantly different from the control.

TABLE 35

Table 35
Genes showing improved plant performance: Growth rate

| Gene Id | SEQ ID NO: of overexpressed polynucleotide | Under regula-tion of | Growth rate ($cm^2$/day) Least Sq Mean | Significance (t-Test compare to control) | % im-prove-ment |
|---|---|---|---|---|---|
| BDL14 | 1024 | 35S | 2.48 | A | 6.4 |
| BDL18 | 1027 | 35S | 2.41 | A | 3.5 |
| BDL20a | 1029 | 35S | 2.50 | A | 7.1 |
| CONTROL (GUS_Intron) | 1049 | 35S | 2.33 | A | 0.0 |

TABLE 36

Table 36
Genes showing improved plant performance: Growth rate

| Gene Id | SEQ ID NO: of overexpressed polynucleotide | Under regula-tion of | Growth rate ($cm^2$/day) Least Sq Mean | Significance (t-Test compare to control) | % im-prove-ment |
|---|---|---|---|---|---|
| BDL11 | 1042 | 35S | 1.80 | A | 15.4 |
| CONTROL (GUS_Intron) | 1049 | 35S | 1.56 | A | 0.0 |

TABLE 37

Table 37
Genes showing improved plant performance: Growth rate

| Gene Id | SEQ ID NO: of overexpressed polynucleotide | Under regula-tion of | Growth rate ($cm^2$/day) Least Sq Mean | Significance (t-Test compare to control) | % im-prove-ment |
|---|---|---|---|---|---|
| BDL1 | 1040 | 35S | 1.81 | A* | 17.1 |
| BDL12 | 1023 | 35S | 1.58 | B | 2.0 |
| BDL14 | 1024 | 35S | 1.95 | A | 26.3 |
| BDL18 | 1027 | 35S | 1.59 | B | 3.1 |
| BDL20b | 1044 | 35S | 1.77 | B | 14.6 |
| BDL26a | 1033 | 35S | 1.57 | B | 1.9 |
| BDL30 | 1046 | 35S | 1.75 | B | 13.0 |
| CONTROL (GUS_Intron) | 1049 | 35S | 1.55 | B | 0.0 |

*P = 0.06

TABLE 38

Table 38
Genes showing improved plant performance: Growth rate

| Gene Id | SEQ ID NO: of overexpressed polynucleotide | Under regula-tion of | Growth rate ($cm^2$/day) Least Sq Mean | Significance (t-Test compare to control) | % im-prove-ment |
|---|---|---|---|---|---|
| BDL32b | 1039 | 35S | 1.19 | A | 0.8 |
| CONTROL (GUS_Intron) | 1049 | 35S | 1.18 | A | 0.0 |

Tables 39-42 depict analyses of rosette area in plants overexpressing the polynucleotides of the invention under the regulation of a constitutive (35S) or seed specific (napin) promoter. Each Table represents an independent experiment, using at least 5 independent events per gene. Genes not connected by same letter as the control (A, B,) are significantly different from the control.

TABLE 39

Table 39: Genes showing improved plant performance: Rossete area

| | | | Rosette area (cm$^2$) | | |
|---|---|---|---|---|---|
| Gene Id | SEQ ID NO: of overexpressed polynucleotide | Under regulation of | Least Sq Mean | Significance (t-Test compare to control) | % improvement |
| BDL6 | 1019 | 35S | 9.73 | A | −10.2 |
| BDL7 | 1020 | 35S | 8.52 | A | −21.4 |
| BDL14 | 1024 | 35S | 11.83 | A | 9.2 |
| BDL18 | 1027 | 35S | 11.62 | A | 7.3 |
| BDL20a | 1029 | 35S | 11.90 | A | 9.9 |
| BDL20b | 1044 | 35S | 11.02 | B | 1.7 |
| BDL24 | 1045 | 35S | 8.12 | A | −25.1 |
| CONTROL (GUS_Intron) | 1049 | 35S | 10.83 | B | 0.0 |

Increase in rosette area means better soil coverage and reduced water loss from soil. Decrease in rosette area means more plants could be put per area increasing yield.

TABLE 40

Table 40: Genes showing improved plant performance: Rossete area

| | | | Rosette area (cm$^2$) | | |
|---|---|---|---|---|---|
| Gene Id | SEQ ID NO: of overexpressed polynucleotide | Under regulation of | Least Sq Mean | Significance (t-Test compare to control) | % improvement |
| BDL3 | 1017 | 35S | 11.99 | A | −3.6 |
| BDL5 | 1018 | 35S | 11.36 | A | −8.6 |
| BDL8 | 1021 | 35S | 9.31 | B | −25.1 |
| BDL11 | 1042 | 35S | 14.09 | A | 13.2 |
| BDL16 | 1026 | 35S | 10.91 | A | −12.3 |
| BDL17 | 1043 | 35S | 9.97 | B | −19.9 |
| BDL25 | 1032 | 35S | 7.95 | B | −36.1 |
| CONTROL (GUS_Intron) | 1049 | 35S | 12.44 | A | 0.0 |

Increase in rosette area means better soil coverage and reduced water loss from soil. Decrease in rosette area means more plants could be put per area increasing yield.

TABLE 41

Table 41: Genes showing improved plant performance: Rossete area

| | | | Rosette area (cm$^2$) | | |
|---|---|---|---|---|---|
| Gene Id | SEQ ID NO: of overexpressed polynucleotide | Under regulation of | Least Sq Mean | Significance (t-Test compare to control) | % improvement |
| BDL1 | 1040 | 35S | 9.13 | B | 12.4 |
| BDL12 | 1023 | 35S | 7.92 | B | −2.5 |
| BDL14 | 1024 | 35S | 9.96 | A | 22.7 |
| BDL18 | 1027 | 35S | 8.63 | B | 6.3 |
| BDL20a | 1029 | 35S | 8.03 | B | −1.1 |
| BDL20b | 1044 | 35S | 9.14 | B | 12.6 |
| BDL26a | 1033 | 35S | 8.51 | B | 4.8 |
| BDL26b | 1034 | 35S | 7.92 | B | −2.5 |
| BDL30 | 1046 | 35S | 9.28 | A | 14.2 |
| CONTROL (GUS_Intron) | 1049 | 35S | 8.12 | B | 0.0 |

Increase in rosette area means better soil coverage and reduced water loss from soil. Decrease in rosette area means more plants could be put per area increasing yield.

TABLE 42

Table 42: Genes showing improved plant performance: Rossete area

| | | | Rosette area (cm$^2$) | | |
|---|---|---|---|---|---|
| Gene Id | SEQ ID NO: of overexpressed polynucleotide | Under regulation of | Least Sq Mean | Significance (t-Test compare to control) | % improvement |
| BDL9 | 1022 | 35S | 5.05 | B | −17.0 |
| BDL21 | 1030 | 35S | 4.77 | B | −21.5 |
| BDL27 | 1035 | 35S | 5.22 | B | −14.2 |
| BDL32b | 1039 | 35S | 6.19 | A | 1.8 |
| CONTROL (GUS_Intron) | 1049 | 35S | 6.08 | A | 0.0 |

Increase in rosette area means better soil coverage and reduced water loss from soil. Decrease in rosette area means more plants could be put per area increasing yield.

Tables 43-49 depict analyses of oil % in seed in plants overexpressing the polynucleotides of the invention under the regulation of a constitutive (35S) or seed specific (napin) promoter. Each Table represents an independent experiment, using at least 5 independent events per gene. Genes not connected by same letter as the control (A, B,) are significantly different from the control.

TABLE 43

Table 43 Genes showing improved plant performance: oil % in seed

| | | | Oil % in seed | | |
|---|---|---|---|---|---|
| Gene Id | SEQ ID NO: of overexpressed polynucleotide | Under regulation of | Least Sq Mean | Significance (t-Test compare to control) | % improvement |
| BDL8 | 1021 | 35S | 30.542 | A | 1.1 |
| BDL25 | 1032 | 35S | 31.09 | A | 2.9 |
| BDL32a | 1038 | 35S | 30.264 | A | 0.2 |
| CONTROL (GUS_Intron) | 1049 | 35S | 30.21 | A | 0.0 |

TABLE 44

| Table 44<br>Genes showing improved plant performance: oil % in seed | | | | | |
|---|---|---|---|---|---|
| | | | Oil % in seed | | |
| Gene Id | SEQ ID NO: of overexpressed polynucleotide | Under re-gulation of | Least Sq Mean | Signi-ficance (t-Test compare to control) | % im-prove-ment |
| BDL6 | 1019 | 35S | 30.565 | B | 0.7 |
| BDL14 | 1024 | 35S | 31.31 | B | 3.1 |
| BDL18 | 1027 | 35S | 30.56 | B | 0.7 |
| BDL20a | 1029 | 35S | 31.393 | B | 3.4 |
| BDL20b | 1044 | 35S | 31.928 | A | 5.2 |
| BDL24 | 1045 | 35S | 31.02 | B | 2.2 |
| CONTROL (GUS_Intron) | 1049 | 35S | 30.355 | B | 0.0 |

TABLE 45

| Table 45<br>Genes showing improved plant performance: oil % in seed | | | | | |
|---|---|---|---|---|---|
| | | | Oil % in seed | | |
| Gene Id | SEQ ID NO: of overexpressed polynucleotide | Under re-gulation of | Least Sq Mean | Signi-ficance (t-Test compare to control) | % im-prove-ment |
| BDL3 | 1017 | 35S | 29.39 | A | 2.1 |
| BDL5 | 1018 | 35S | 29.29 | A | 1.8 |
| BDL8 | 1021 | 35S | 28.903 | A | 0.4 |
| BDL11 | 1042 | 35S | 29.216 | A | 1.5 |
| BDL17 | 1043 | 35S | 28.904 | A | 0.4 |
| BDL25 | 1032 | 35S | 29.514 | A | 2.6 |
| CONTROL (GUS_Intron) | 1049 | 35S | 28.78 | A | 0 |

TABLE 46

| Table 46<br>Genes showing improved plant performance: oil % in seed | | | | | |
|---|---|---|---|---|---|
| | | | Oil % in seed | | |
| Gene Id | SEQ ID NO: of overexpressed polynucleotide | Under re-gulation of | Least Sq Mean | Signi-ficance (t-Test compare to control) | % im-prove-ment |
| BDL3 | 1017 | Napin | 30.34 | A | 0.46 |
| BDL6 | 1019 | Napin | 30.45 | A | 0.83 |
| BDL28 | 1036 | Napin | 29.49 | A | 2.35 |
| CONTROL (GUS_Intron) | 1049 | Napin | 30.2 | A | 0 |

TABLE 47

| Table 47<br>Genes showing improved plant performance: oil % in seed | | | | | |
|---|---|---|---|---|---|
| | | | Oil % in seed | | |
| Gene Id | SEQ ID NO: of overexpressed polynucleotide | Under re-gulation of | Least Sq Mean | Significance (t-Test compare to control) | % im-prove-ment |
| BDL12 | 1023 | 35S | 31.30 | A | 3.7 |
| BDL14 | 1024 | 35S | 30.27 | A | 0.3 |
| BDL18 | 1027 | 35S | 30.39 | A | 0.7 |
| BDL26a | 1033 | 35S | 30.33 | A | 0.5 |
| BDL26b | 1034 | 35S | 30.43 | A | 0.8 |
| BDL30 | 1046 | 35S | 31.42 | A | 4.1 |
| CONTROL (GUS_Intron) | 1049 | 35S | 30.19 | A | 0.0 |

TABLE 48

| Table 48<br>Genes showing improved plant performance: oil % in seed | | | | | |
|---|---|---|---|---|---|
| | | | Oil % in seed | | |
| Gene Id | SEQ ID NO: of overexpressed polynucleotide | Under re-gulation of | Least Sq Mean | Significance (t-Test compare to control) | % im-prove-ment |
| BDL21 | 1030 | 35S | 30.55 | A | 1.8 |
| BDL32b | 1039 | 35S | 30.35 | A | 1.1 |
| CONTROL (GUS_Intron) | 1049 | 35S | 30.01 | A | 0.0 |

TABLE 49

| Table 49<br>Genes showing improved plant performance: oil % in seed | | | | | |
|---|---|---|---|---|---|
| | | | Oil % in seed | | |
| Gene Id | SEQ ID NO: of overexpressed polynucleotide | Under re-gulation of | Least Sq Mean | Significance (t-Test compare to control) | % im-prove-ment |
| BDL25 | 1032 | Napin | 30.34 | B | 1.5 |
| BDL29 | 1037 | Napin | 31.54 | A | 5.5 |
| BDL32b | 1039 | Napin | 31.69 | A | 6.0 |
| CONTROL (GUS_Intron) | 1049 | Napin | 29.90 | B | 0.0 |

Tables 50-55 depict analyses of weight of 1000 seeds in plants overexpressing the polynucleotides of the invention under the regulation of a constitutive (35S) or seed specific (napin) promoter. Each Table represents an independent experiment, using at least 5 independent events per gene. Genes not connected by same letter as the control (A, B,) are significantly different from the control.

TABLE 50

Table 50
Genes showing improved plant performance: weight of 1,000 seeds

| | | | Weight of 1000 seeds (gr) | | |
|---|---|---|---|---|---|
| Gene Id | SEQ ID NO: of overexpressed polynucleotide | Under re-gulation of | Least Sq Mean | Significance (t-Test compare to control) | % im-prove-ment |
| BDL8 | 1021 | 35S | 0.019 | B | 9.1 |
| BDL21 | 1030 | 35S | 0.018 | B | 0.3 |
| BDL25 | 1032 | 35S | 0.018 | B | 0.4 |
| BDL32a | 1038 | 35S | 0.019 | B | 5.5 |
| BDL32b | 1039 | 35S | 0.020 | A | 14.2 |
| CONTROL (GUS_Intron) | 1049 | 35S | 0.018 | B | 0.0 |

TABLE 51

Table 51
Genes showing improved plant performance: weight of 1,000 seeds

| | | | Weight of 1000 seeds (gr) | | |
|---|---|---|---|---|---|
| Gene Id | SEQ ID NO: of overexpressed polynucleotide | Under re-gulation of | Least Sq Mean | Significance (t-Test compare to control) | % im-prove-ment |
| BDL6 | 1019 | 35S | 0.019 | B | 7.1 |
| BDL7 | 1020 | 35S | 0.018 | B | 3.8 |
| BDL14 | 1024 | 35S | 0.019 | B | 6.1 |
| BDL18 | 1027 | 35S | 0.019 | B | 8.2 |
| BDL20b | 1044 | 35S | 0.020 | A | 14.5 |
| BDL24 | 1045 | 35S | 0.018 | B | 4.5 |
| CONTROL (GUS_Intron) | 1049 | 35S | 0.018 | B | 0.0 |

TABLE 52

Table 52
Genes showing improved plant performance: weight of 1,000 seeds

| | | | Weight of 1000 seeds (gr) | | |
|---|---|---|---|---|---|
| Gene Id | SEQ ID NO: of overexpressed polynucleotide | Under re-gulation of | Least Sq Mean | Signi-ficance (t-Test compare to control) | % im-prove-ment |
| BDL3 | 1017 | 35S | 0.0214 | B | 5.8 |
| BDL5 | 1018 | 35S | 0.0205 | B | 1.1 |
| BDL11 | 1042 | 35S | 0.0235 | A | 15.7 |
| CONTROL (GUS_Intron) | 1049 | 35S | 0.0203 | B | 0 |

TABLE 53

Table 53
Genes showing improved plant performance: weight of 1,000 seeds

| | | | Weight of 1000 seeds (gr) | | |
|---|---|---|---|---|---|
| Gene Id | SEQ ID NO: of overexpressed polynucleotide | Under re-gulation of | Least Sq Mean | Signi-ficance (t-Test compare to control) | % im-prove-ment |
| BDL2 | 1016 | Napin | 0.0290 | A | 30.7 |
| BDL6 | 1019 | Napin | 0.0232 | B | 4.3 |
| BDL14 | 1024 | Napin | 0.0227 | B | 2.3 |
| BDL28 | 1036 | Napin | 0.0224 | B | 1.0 |
| CONTROL (GUS_Intron) | 1049 | Napin | 0.0222 | B | 0.0 |

TABLE 54

Table 54
Genes showing improved plant performance: weight of 1,000 seeds

| | | | Weight of 1000 seeds (gr) | | |
|---|---|---|---|---|---|
| Gene Id | SEQ ID NO: of overexpressed polynucleotide | Under re-gulation of | Least Sq Mean | Signi-ficance (t-Test compare to control) | % im-prove-ment |
| BDL1 | 1040 | 35S | 0.0235 | B | 0.6 |
| BDL12 | 1023 | 35S | 0.0234 | B | 0.1 |
| BDL30 | 1046 | 35S | 0.0252 | A | 7.8 |
| CONTROL (GUS_Intron) | 1049 | 35S | 0.0234 | B | 0.0 |

TABLE 55

Table 55
Genes showing improved plant performance: weight of 1,000 seeds

| | | | Weight of 1000 seeds (gr) | | |
|---|---|---|---|---|---|
| Gene Id | SEQ ID NO: of overexpressed polynucleotide | Under re-gulation of | Least Sq Mean | Signi-ficance (t-Test compare to control) | % im-prove-ment |
| BDL12 | 1023 | Napin | 0.0206 | B | 0.2 |
| BDL18 | 1027 | Napin | 0.0214 | B | 4.0 |
| BDL25 | 1032 | Napin | 0.0208 | B | 1.1 |
| BDL27 | 1035 | Napin | 0.0211 | B | 2.8 |
| BDL29 | 1037 | Napin | 0.0211 | B | 2.6 |
| BDL32b | 1039 | Napin | 0.0224 | A | 9.3 |
| CONTROL (GUS_Intron) | 1049 | Napin | 0.0205 | B | 0.0 |

Taking into account the results obtained using these assays, the following BDL genes, when exogenously introduced into plants, induced a significant improvement in:

1. Seed yield: BDL1, BDL3, BDL8, BDL14, BDL27, BDL32b.

2. Oil yield: BDL1, BDL3, BDL8, BDL14, BDL29, BDL32b.

3. Harvest Index: BDL17, BDL28.

4. Growth rate: BDL1, BDL14.

5. Roseate area: BDL14, BDL18, BDL20a, BDL30.

6. Oil % in seed: BDL20b, BDL29, BDL32b.

7. Weight of 1000 Seeds: BDL2, BDL11, BDL20b, BDL30, BDL32b

Example 7

Increased Oil Content in Leaves

In general, oil is composed mainly of tri acyl glycerols (TAG). Seeds of *Arabidopsis* and other oilseed contain high amounts of TAG. Usually the TAGs are being degraded into sugars through the germination process. Cermac and Benning (*Plant journal* 2004; 40, 575-585) in their paper used an assay to quantify TAG production in seedlings grown on sucrose. They used this stage of development since normally seedlings not present TAG in high levels. In their study, they demonstrated the importance of the wrinkled gene in the control of oil production by showing that transgenic seedlings overexpressing the wrinkled cDNA produce high amounts of TAG.

Materials and Experimental Methods

The present inventors used the assay of Cermac and Benning assay (Cermac and Benning, *Plant journal* 2004; 40, 575-585) with minor changes to qualify the effect of the transgenes identified herein for their ability to increase TAG in seedlings, similar to the wrinkled gene.

For triacylglycerol quantification $T_2$ transgenic seedlings were grown on ½ MS medium (Murashige and Skoog, 1962 Plant Physiology 15, 473-497), pH 5.9, 2% sucrose and 0.7% agar. Seeds were sterilized by evaporating of 100 ml bleach (10%) and 4 ml HCl (37%) for 90 minutes in close plastic chamber of 5.5 L vol. Glufosinate-ammonium and kanamaycin were added to final concentrations of 20 $\mu g\ ml^{-1}$ for glufosinate-ammonium and 50 $\mu g\ ml^{-1}$ kanamaycin. Follow sterilization, seeds were sown on agar plates. Plates were incubated for 3 days in the dark at 4° C. before placing them in a growth room. The conditions at the growth room were of 24° C., light period of 12 hour and a dark period of 12 hour. Seedlings were grown for 10-11 days.

Equal amount of 11 days old seedlings were ground in 1.5-mL polypropylene test tubes with a glass rod, and lipids were extracted in 50 mL of chloroform:methanol:formic acid (10:10:1, v/v). Following the extraction with 12.5 mL of 1 M KCl and 0.2 M $H_3PO_4$ and separation of the organic and aqueous phases by centrifugation at 16,000 g for 5 minutes, the lipids in the lower phase were separated on a silica TLC plate (Si 250 PA, J. T. Baker, Philipsburg, N.J.) developed with 80:20:1, petroleum ether:ethyl ether:acetic acid. Lipids were visualized by staining with iodine vapor.

As positive controls the following were used: The naturally produced TriAcyl Glycerols—extracted from seeds of wild-type *arabidopsis* (lane 5, FIG. 3); and transgenic seedlings expressing WRINKLED cDNA (SEQ ID NO:1050), which are known to produce significant amounts of TriAcyl Glycerols in leaves (Cernac A and Benning C, The *Plant Journal* 2004, 40, 575-585). As negative controls the transgenic seedlings expressing GUS-Intron gene (SEQ ID NO:1049) were used.

Experimental Results

FIG. 3 depicts iodine vapor staining of lipids isolated from the transgenic plants of independent events (BDL9, WRINKLED) or pool of events (GUS-Intron) expressing the following genes according to Table 56, hereinbelow. An independent Event represents a single stable transformed plant that resulted from random integration of the transformed construct in the *Arabidopsis* genome. Progenies of an event harboring the transformed construct were used for the gene evaluation separately as in the case of BDL9 and Winkeld genes or as pool of events in case of GUS-Intron.

TABLE 56

Table 56

| Lane No. | Description of plant transformation | Name of upregulated gene or control plant |
|---|---|---|
| 1 | Transformed with SEQ ID NO: 1022 | BDL9 Event 1 |
| 2 | Transformed with SEQ ID NO: 1022 | BDL9 Event 2 |
| 3 | Transformed with SEQ ID NO: 1022 | BDL9 Event 3 |
| 4 | Transformed plant with control vector SEQ ID NO: 1049 | GUS-Intron |
| 5 | Untransformed plant | SEED |
| 6 | Transformed with SEQ ID NO: 1050 | Wrinkled Event 1 |
| 7 | Transformed with SEQ ID NO: 1050 | Wrinkled Event 2 |
| 8 | Transformed with SEQ ID NO: 1050 | Wrinkled Event 3 |

As shown in FIG. 3, transgenic plants expressing the BDL9 gene (SEQ ID NO:1022) produce a significantly higher oil content as compared to the oil content produced by control plants expressing the GUS-intron (SEQ ID NO:1049). In addition, the amount of oil produced by the BDL9-transgenic plants (e.g., FIG. 3, lane 2) is comparable to that produced by seeds (FIG. 3, lane 5) or by transgenic plants expressing the known Wrinkled gene (FIG. 3, lane 6).

SUMMARY

The present inventors have identified genes from *Arabidopsis thaliana*, which are important for embryogenesis, seed development and oil synthesis and accumulation. These genes, when over-expressed in plants, can effectively increase oil content in seeds or leaves or any other plant part. Tissue or embryonic specific expression of the genes in plants can result in optimal increase oil content in any plant tissue. Thus, the transgenes can be expressed in certain stages of embryo, seed development or to developmental stages of any target tissue, defined as the oil accumulating tissue. This unique expression profile can be achieved by using specific promoters, such as developmental promoters, seed expressing and seed specific promoters.

The present inventors demonstrated improvement of oil synthesis and accumulation by increasing seed size, which enabled the synthesized oil to be accumulated to larger extent, within a larger volume.

In addition, increase of oil can be achieved by controlling embryogenesis. Oil is accumulated in the embryo of developed seed. Some of the early embryo development genes are directly in charge of the regulation of oil synthesis and storage.

The identified genes of the invention can improve oil yield in general, and more specifically oil synthesis, oil accumulation and seed size. The output of the bioinformatics method described herein is a set of genes highly predicted to improve oil and seed yields by modifying their expression. Although each gene is predicted to have its own impact, modifying the mode of expression of more than one gene is expected to provide an additive or synergistic effect on the plant seed/oil yield performance. Altering the expression of each gene described here alone or set of genes together increases the overall oil yield, hence expects to decrease vegetable oil price, as well as to increase productivity.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

CD-ROM Content

The following lists the file content of the CD-ROM which is enclosed herewith and filed with the application. File information is provided as: File name/byte size/date of creation/operating system/machine format.

CD-ROM1 (1 file of SEQUENCE LISTING):

1. "40040_ST25.txt"/1,820,000 bytes/Apr. 9, 2008/Microsoft Windows XP Professional/PC.

SEQUENCE LISTING (1052 sequences)

SEQ ID NO: 1 - DNA, 1168 bp, Arabidopsis thaliana
aaaccattgtgaagtatagtccttgatgcatggattcaatcaacaagatcatcaacttcttgtttcctctcttaaccttgtatgcacttcttgtcttctacccaacttaccagaggctcaaatccgccgtctccatctgccggaatctgttctcggaaaatgtcgccggaaaagttgttgtcatcaccggagcagcttctggcatcggcgaggctttagcgtatgagtacgggaagaggggagcgtatttagcacttgttgacataagaggagaacctctcttccatgtagcggctctcgctgagctctatggctcccctgaagtcttgcccttagtagccgatgtttccaaactccaagactgcgagcgttttatccgagccacggttcttcattttggacgattggatcatctagtgacaaatgcaggagttgctccactctatttttttgcagacatcgaagatgtctctaaggcttcgccggctatggacatcaacttttggggatctgtgtattgcacattttttgcttctccatacctaaagaagtttagaggaaggattgtggtgattgcttctggatgtggatacattgcttcacctagactaagcttttactgtgcgagtaaagctgctgtgatcgccttttatgaaacactaagaactgagtttggatcagatattggggttaccattgtagcaccggggatcgtcgattcggaaatgagccgaggcaagttcatgacaaaggacggtaaacttgtcgtcgataaagagctcagagatgtgcaaatgagcgtattgccagtagaatcagccgagaggtgtgcgaaagcaataatgcggagcgtatgtagaggagataggtacttgttggaacccgactggataggttgtgtcatattgttgaaggttttttgttctgaggcaacagagtgggtagcccggtggctgctgatagccagaccaaaatttccaatgatggaggctcttagcaacaagatccttgatgtagcccatgcctttaattctttcttctcttttcctcattattaggaatatcgatacttgagtctccccgtttatgtgttttttttaactaaaactactgtatacaacttcgggttaccatagtgtattggccagcttgatataattaatactat

SEQ ID NO: 2 - DNA, 1233 bp, Arabidopsis thaliana
agaagttttgcctctctttctctctctccgtctcttggtccttattctctctttcttgctactggaatctgcaatgagttctttgctttcgaagttgccgcaacctaaacagaattgaaaacagtacgtagtaccatgagtcaaacaatggaggaatatcagtctaatgagagtgaagataaaagaagttggatttggagtaaggcggtaagtgttgggaagaaagttctgacagctggtgttgtagtgtcttcagctccacttcttgttccttcactttttgtcgcctcgacacttgccttcctctcctcggttccgttttgtctcttcttggctaattatgcttgtacacaaaaggtcatgagtactctgcttcctgatactgaagaaactggtggagttggcaaggaggatgatgacgaatctggatttgatgagtatagcaagattggtcacggtgaaggcgcggctggagttggtgaggctgcacttttcaggggtaaagaagaacccattcccattcaggttaaggaagatgaggagatggcgaaagagtcaacgagcttgctagagaaaattagggatgagggtagaactgacaaagaaacctctgagagaactttacaagatgataaaaagtccggaaatgctaagtcagaggaggttcaagaacagcctgaaaagcgggaagcgcctgagactagacgtgaaggggaaactggggctacaaaaattgaaacttctacgggcaaggacgatgaggaaatatcttctaatgagccaatagaccaagctagtggggcacaaggaaccggggaagagaaacgaaaaaacacaactaagaaaaagaagaaaaccgggcgtgcaggtgtatagtgaggagcaactatgggagacgatggagactttgaggaaagtagtaggatacagtgttgcaaggagtgccacatgtgcagaggagttaaaggctctctatgtcttcaccggtgtagtggagccacctcgctcaagcttaaaccaggacacttatgatattgcacatcttactattagacttcgcttcctcatgtctgttatcggaataaactagtttgatggtgtgttttgtgtgctagattcacgagatgtgttgtgtagtactgaatctcaactttgtatgtacttttgttgccacttttggtcctagttttactattttgaatgttttatagtattacatcaatgggattacac

SEQ ID NO: 3 - DNA, 1918 bp, Arabidopsis thaliana
aatgtattctctttgttcatttggttttacaaccaaaaaaaaacaaaaaaaaaacacttcatgcgtaagacataagcaaaatggccggtggaggattggctcttgatgtctccagcgccggaaacattgatgccaagatcacagccgcagttgtcatgagttgcattgtggctgcctcatgtggtctcatttttggctatgacatcggaatctcagggggtgtgacgactatgaagccgtttcttgagaaattctttccatcggttcttaaaaaagcttcggaagctaagacgaatgtctactgcgtctacgacagccaacttcttacggccttcacatctagcctttatgttgccggcttagtagcttccttagtggctagccgtctcacagcggcttatggtcgccgaaccaccatgatccttggcggtttcactttcctctttggtgctctgatcaatggcttagctgctaacatcgccatgctcatctccggtcggattttgctaggatttggtgtcggtttcaccaaccaggcggctccggtatatctatcggaagtagcaccaccgcgatggcgtggagcattcaacatcggcttttcatgcttcatcagtatgggagtagtagcagccaatctaataaattacggtaccgatagtcaccgtaacggctggcgtatctcgctaggtctagctgctgtaccagccgcgatcatgaccgtgggatgtctattcatttccgacacaccttctagcctcttggcgcgtgggaaacacgatgaagctcacacgtcgctgcttaagctacgtggcgtcgaaaacatagctgacgtggaaaccgagctagcagagttggttaggtcaagccagctagccattgaggctagagccgaactgtttatgaagacgatattgcagagacggtataggcctcatcttgtggttgctgtggtgataccatgttttcaacagttaactggaataacggtgaacgcgttctatgcgccggttctgtttcgatcggttgggtttggttctggtccggctcttattgcgacgttcatactcgggtttgttaatcttggttcgcttcttctctcaacaatggttattgaccggtttggtagacggtttttgttcattgctggcggtattctgatgcttctctgtcagattgcagtggctgtgttactagctgtgacagtgggagccaccggggacggagagatgaagaagggttacgccgtgacggtggtggtgttactttgcatatacgcagctgggtttggatggtcgtgggggccattaagctggcttgtcccaagtgagatattcccactcaagatacgaccagctggtcagagcttaagcgttgccgtgaacttcgccgcaacgtttgctctctctcaaacgttcttagcaacgctctgcgatttcaagtacggtgctttcttgttttacggcggttggatctttacaatgacgatattcgtcatcatgttcttgcccgagaccaaagggatacctgtggattctatgtatcaagtttgggagaagcattggtattggcaacggtttactaaaccgacgtcaacttaaaagatgcaatattgcaatgggttcgcattttcaatggattatgtttattaattagttaggattaaaaggatatatgagtcatgactaatcagtaatcacaatattgttttaatatcgaagttgcattggtaacttggaacaagtatacgttcgagaacatattgttttaaccacgtagctacgtggtaaggtgggaggtcaactgaccccaacagattttgtaaattataaatatttatttgtattttaatttttaagtgtaaaacttaagtgaactggttaataatgtttatgatgatccctatatcttttgttct

SEQ ID NO: 4 - DNA, 1326 bp, Arabidopsis thaliana
gaaaaagagaaaatagagagagatcgttttttttttgttagctttgtcgtcgcttggctttaaagactttcttctctatactctcctcttaccaaaccctaattctcctctcttgattcccgtttctcaaatcttcctctcatcttcaaacaataccaaacataatctccatatttttactcaacaagtttaaaaccctaacgcaagagtggggagatagagtaacaactcgttaattggggggtggccggtcatgagcggtggtgggaacacaatcactgccgtgggaggcggaggtggtggttgtggtggaggaggcagcagtgggggaggaggaagtagtggcggtggtggtggtgggccatgtggtgcttgtaagtttctaaggaggaagtgtgtgccgggatgtatatttgcaccgtactttgactccgagcaaggatcggcttattttgcggcggtgcataaagtgttcggagccagtaacgtctcgaagcttctattacacataccggttcatcgaaggtccgatgctgtcgtaacaatttgctatgaagctcaggctaggataagggatcctatctacggttgcgtcgctcacatctttgctcttcagcaacaggtggtgaatctacaggcagaagtttcttacttacaagcccatttggcatcactagagctacctcaaccgcaaacgcggccacagcctatgccgcaaccgcaaccgctctttttcactcctcctccccctcttgccataaccgatttacctgcatcagtctcacccttgccctcaacctatgacctagcatccatcttcgatcaaacgacgtcttcttcggcatgggccacgcaacaacgaagattcattgatccacgtcaccaatacggtgtatcatcgtcttcctcttctgtcgccgtggggctcggtggtgaaaacagtcatgacctccaagcattagcacatgaactcctccatagacaaggatctcctcccccggcagctaccgaccactcgccgtctcgaactatgtctagatgagttggttttgatcgatacatctccgcattgttattaggaaaattaaattacaactcaataagatttaattttctttgaaagtactgattataaattttctaacatttatattgtattactactgtattttcacttcttttgactgacgagtattttctttcttctttgcctttactttttttctcctattacgtaagtttttgaatatatcccgagtcatacatacgtttcctaatcagttgtatatactccatcttcttatttctgcctcgggcattttctcg

SEQ ID NO: 5 - DNA, 2468 bp, Arabidopsis thaliana
cagagacatgcacaaagacaacgattcgggttcgggttcgaatccgggtcaggtttcgaactacttgattgttcgaccgcaccgaggtgggtacatagacttgttccggtacggtgtgagagatgaccaaacgagcaaggcaaagttcttggagatgcctgataaccgcgaatggagcacgataacgattgatgaagaagcagaggatcaccgttgggtaatcgtggtttcgattctggttcgtaagattatcagacttctccgaacaccaatggaattcacaggtttcgtcgttgacttcttccttaatctgttctctgcgaatggtgggttcttcggtttgcttctccggttgattcaagcgaaagttgtgataccagaaagaggctctgtgacgtttgttagtacaattgggcaacttgatgggagaattagtctgtataaggaatggaatttcgtcgaacacttggagggcattgactcggttgattctggaagggttaaaatcgaattgggaagtcgtgggcttatggatttgtgtgtgatggcgtctaagcttgcgtatgaaaatgctaaggttgttgaaaacgtcgttgatcttcattggaagatgaatctggtggagttcttggattgttggaatgattatcagaagcagatgtctacacaagtttttgtgtttacggataagcagaaagatgcaaacttgatagtaatcagcttcagaggtactgagccgtttgatgctgatgattggggaacagatttcgactattcgtggtatgaagtccccaatgtgggaaagcttcacatgggtttccttgaagctatgggtttaggcaacagagacgacactaccactttccattacaatctctttgaacaaacctcctctgaggaagagaatagtaaaaagaatcttctggatatggtagagagaagcgcttattatgcagtccgagtcattctgaaacgtttgctttcggaacacgaaaacgctcggtttgtagtcactggtcacagcttaggaggtgctttagcgatactgtttcccacattgttggtgttgaatgaggaaacagagataatgaagaggctgcttggagtttacacgtttggacaaccaagaatcgggaacagagaggtcgggttattcatgaaagctcaactgaatcaacctgtggatcgatacttccgagtcgtttactgcaacgatatcgtcccgagattgccctacgacgacaaaacgttcctctataaacatttcggactctgtcttttctatgacagcttctacaacgaaacaaaagcagaggatgagccggacccgaacccttacggtctgcgttacaagattcttgggcatgtgatcgcagtttgggagttggttagaggcttgacgatggggtacactcatggaccagattacaaagagggatggtttaggatcttgtttaggcttatggggctggtgattcctggtctgtcggatcattgcatgactgattacgtgaactcggttaggcttggacccgataatgaacttcagatgtcctctctttgaaaagtgctctgtttttttcaaccggaactatatgttcttggaataaatcttaagtgaaccggaactatatgttcttggaataaatcttaagtgaaccggaactcggttaagatgttggttcgtaaaatataataagaacctaattttgccaaaattatagttttattcttttgactagtttgttcgtcgcattattattacaactagaggcaacaatcaaacaagatcttacacaaccagaagagatttctttggtcaaaatgaaactaaatccaaaacttcccaaagatttcaactcgttttcttacataacttcttctaaactccaccagctcaatcggcggataaaatctctctctttcaattgatgtaaaataacccatgaaaataaaaaccaaaagattgattctttaggttaaaaaaagtaacaagattttgaagggttattgcaccaaatgaagagagagaatcaaaagttctagccttctaggatagggttcaagccatgcaaccaagcagccaccaacaccaacggagagcttcacatcaatggagcttcaagaaggagacatggagaggggagggggtatatatacatatactaatatgtaaaggttaatttgaaggaggagtcaaatggttctctctactcatcgccatggatgtaccagcagcaaagcatggtggcacaacggcggagaatgtagagacgagctcgttgttccttcaccaaggaaacacatttgcttgtaaaagcgtgtcctttgttgaactttctctttaatcctgccatgggattgaattagggtttatattatgttttagtgatcaaaagttgggtggcaccaaaaaaaaaaaccctctaatgggtgaaggaagagagtgcaaatgaaaggtttgtgat

SEQ ID NO: 6 - DNA, 1261 bp, Arabidopsis thaliana
attatcgctctcacttcagattttaaaccaatcatggcagcatcaaaactcctcgtatccgacatcgcctctgtcgttgatcacgtcccttcaaactacgtcagaccagtctctgaccgtccaaaaatgtccgaggttcaaacttccggcgactctattcctctaatcgatctccacgacctccatggacctaatcgagctgacattatcaatcagtttgctcatgcatgctcttcttgtggcttcttccagatcaagaaccatggagtaccagaagaaacgatcaaaaaaatgatgaatgcggcaagagagtttttccggcaatcagagagcgaaagagtgaagcattactcagcagataccaaaaagacaacgagactctccacaagtttcaacgtttccaaagagaaagtctctaactggagagacttccttcgactccattgctaccctatcgaagatttcatcaatgaatggccctcaacaccgatctctttcagagaagtcacagccgaatacgctacaagcgttagagccttggttctgacacttcttgaggcaatctcagagagcttaggtcttgcgaaagaccgtgtaagcaatacaataggcaaacatggtcaacacatggctattaactactatccccggtgtcctcaaccagagctaacttacggacttccggggcataaagatgcaaacttgatcactgttcttcttcaagatgaagtctctggtttacaggtgtttaaagatggtaaatggatcgctgttaatcctgttcccaacactttcatagtcaaccttggtgaccaaatgcaggttataagcaatgaaaaatacaagagtgttcttcacagagcggttgtgaacagcgacatggagcggatatcgataccgacattctactgtccttctgaagatgctgtgattagtccagcacaagagctgatcaatgaggaagaagactctcctgctatttacagaaactttacatatgctgaatattttgaaaagttttgggacacagcatttgatactgagagctgtattgactcgttcaaagcatccaccgcctaagatagtgtactatcgaatcaatcatccgtcatgactaggccggtccttagttcttgattggaactcaaatacccatttgtgttgccatttcaagatcagtatagttttctttaatgaacaaatctgcctgagaagtaaaacaaactgttcttgcaacattttgaaatcattatgtttttat

SEQ ID NO: 7 - DNA, 1738 bp, Arabidopsis thaliana
atgaatatgatgatgcaaaaactctctattctatttctacatttaatattactagtactactctgcgtccatcctctcaccaccgtagccgaccgcaattccaccgattggtgcgacaaaactccataccctgatccatgcaaatgctacttcaagaaccacaacggatttcaacagccgacacaattatccgagttccgagtaatgctggtggaagcagccatggatcgggccatatccgcccgtgccgagttgactaattccggcaagaactgcacggatagcaagaaacaagcagttttggcggattgcattgacctctatggagacacgatcatgcagttaaaccggacattgcatggcgtgtctcctaaagccggtgccgcgaaaagttgcactgacttcgacgctcaaacgtggctgagcaccgcgcttacaaacaccgagacctgccgacgtggctcatccgatttaaacgtcacagacttcatcacacccatcgtttcaaacaccaaaatctcccacctcattagcaactgcttagccgtcaacggagccctcttgaccgctggaaacaaaggcaacaccactgctaatcaaaagggctttccgacgtggctttcccgtaaagataagagactcctgcgtgccgttcgagccaacctcgtggtggccaaggacggatcaggacatttcaacacggtacaagcggctattgacgtggcgggacggagaaaggtgacgtcagggaggttcgttatatacgtaaaaagaggtatatatcaagaaaacattaacgtacgtctaaataatgatgacataatgttggtcggagatggaatgagatccaccattatcaccggcggtcgaagtgtccaaggaggttacaccacgtacaattccgctactgccggtatcgagggacttcacttcattgccaaaggcataacgtttaggaacacagctggtccagccaagggccaggccgtggcacttcgttcatcgtctgacctctcaatcttctacaaatgctcaatcgaaggataccaagatacactgatggtccattctcaacgccagttttaccgtgagtgttacatctatggaaccgtcgatttcatattcggtaacgcggctgctgttttccaaaactgtctcatcctccctcgccggccactcaaaggtcaagccaatgtaattaccgcacaaggtcgtgctgatccgtttcagaacacagggatctctatccataactcaagaatcctaccggctcctgatctaaaaccagtggtcggtaccgttaagacgtacatgggccggccttggatgaagttctcacgaaccgtggttcttcagacgtatttggataatgttgtgagtccagtcgggtggtctccgtggattgaaggttcggtgtttggtctggacactctcttctatgcagaatataagaatactggaccagcttcatccacgaggtggcgtgtcagttggaaagggtttcatgtgttgggtagagcttccgatgcatctgctttcactgttggaaagtttatcgctggtacagcatggctcccacgcaccggcatacccttcacttctggactctaaagaccgtctttggtttttcgtgtttaagttgcaatgatataaattttatacttttgaatatataactcattatgcctattatgaaactgaagttttagctatagatggaagaacgagatttcagtac

SEQ ID NO: 8 - DNA, 1243 bp, Arabidopsis thaliana
cctctgtcttgtcttttggttagtataagtattgataaattcctttgaccagcaagatatcatcactaaaagattttacattaccaagccatctccaatatcatcaggtcaagtgatgttgtttctaaccgcggctgtctgtttaatatgcttttacgtctacaagtccgtgaaaccgccgccgccaattccattgccggagaatgtttctgagatatctccaagaatcaagctcaacgatggcagatatttagcttacaaagaattagggtttcctaaagacaaagccaaaaataagattatcattctccatggattcgggagttccaagttagtggatttaaaaatcacacaggaaatgatcgacgaattcgagatatacttcttgttgttcgatagagctggttatggagaaagcgatcctcatccatcacgaacactaaaaacggatacatatgacatcgaagaacttgctgacaaattgcaaatcggtccaaagttccatgtcctaggaatgtcactcggggcttatccagtttacggctgtctcaagtacattcctcatagactaagtggagcaacgttggtggttccgatactgaatttttggtggagttgtctgcctctaaacttgtcgatttcagcgttcaagaaattgccaattcaaaatcagtggacacttggagtcgcacactactttccatggttattatattggtggatgactcagaaatggttttccccatttagtcagaatcctagagaaactatgaccgagcgcgatatagagctcgcggataagcatacaaaacacgcatatattaaggaatccgcactacgacaaggtgaatatgtgagcatgcaacgagacatcattgcgggttacgagaattgggagtttgatccaaccgaactgagcaatccattttcagatgataacaaagggtcagttcacatttggtgtgcactcgaagacaaacaaatttcgcatgaggttttactctacttatgtgataagcttccatggataaagcttcatgaagtccctgatgctggacatcttattatccatgagaagcagcattttgaagacattattaaagccgcttgtagttgaaggttaaaaaaaaaaacttaattcaatagtttgtgtgtggactggatttgaaagttgatattatataaaatatatgttcaatgtcacatatatatattttgttacaattaaattcattttactact

SEQ ID NO: 9 - DNA, 1220 bp, Arabidopsis thaliana
ctctctaaacgcataatcttacaataaaatggtgaaactcgcgacggcgcgtgagattagaacgtacggccctcggcttgggaggagcagagccgagtacatcaacgcaggtctatacttgtttgcaaccgtggtgctcatcggcggtttcacagcgacaggattctcatgggaaccaagatccggcctcgtccttattctcttagctctcgttcttataaccgccgtgaatgttcatgatcttgtggctcatctagctggaatcgattaccggttaaggttaatggagtatgatttgcaactggggctagtggaatttgcagtccctctggttcagatagcgggttcggtagtgtttttcttgggaatctttttcgtcttccatcaggctgagacaaaacgtggatacagtggaagagagcatcatgcattaaacttgctgatagcgggtccgttactttggttgataggatcgattcacaactcatgccaaatctacgagagagcggatagtcatgttcaaattctacagcagtgtgtttacattcctttcttggttggatcccttctattcttggtttccgcagttctcaatagcctcgacatatccgggtcatctcgtagtggattgaagcttcttggggaaagatggatttggcttgggatttccggggctatatgtttgtttgtgggaggattgctgaacgttgttaaggtttttaacttcgtccagatctctgggctccgcctcgagaaactacggggtggagctcaagaccgacttcttgaagggagagaaggatatctccctcttgttgctgaagaagaaagaataaggaaaatggaagctgatcacgaagcttctagtagagccaaaccccgggcacacacaacctccaaagccggagagggagctacagagaccgtggtggtatcatctccgacaccatacaaggatgttctcgttggacagatctgaggaagattagtcatgtttaaatgttcttttgtactccatatttgtttttagctgcggagaccacatattttgccgttcaacatatgttatgtgattcgtttcctttttggtcagtctttatgaatattgaaataggttacaatacatcaagactttagaagaagatttgtacactagaagaatattgatcttctttatgaataatgaaatagggtctttatacctatttctatttgacgat

SEQ ID NO: 10 - DNA, 1647 bp, Arabidopsis thaliana
aaggttcttcgttgacatactattctctgttgtagcaacactaagaagaagcagagaaaatgagaaaccttagcttcatcgtcttatttctattgaccctcttcttcattcatcatttggttgatgcttctttgctagtgaagtctcttcctggttttgaaggtcctcttccttttgagctcgagactggatatgtgagtattggtgaatctggagatgttgagctcttttactactttgtgaaatcagagaggaatccagaaaatgatcctctcatgatttggctcactggtggacctggctgcagctccatctgtggattgctcttcgcaaacggtcctttagcttttaaaggggatgagtataatgggacagtacctcctctagagttgacatctttttcatggacaaaggtggctaacattttatatttggaagctcctgctggctctggatactcttatgcgaaaactcggcgtgcttttgagtcgagcgacaccaaacaaatgcaccaaattgatcaatttcttaggagttggtttgtgaaacacccggagtttatatcgaatcctttttacgttggtggagattcatattccgggaaaattgttccaggagctgtgcaacaaatttcacttggaaatgagaagggcctcacaccactcataaatattcagggttatgttcttggaaaccctgtgacagataaaaacattgaaactaactatagagttccatttgctcatgggatgggacttatttcagatgagctctttgagtcacttgaaagaagttgtggaggcaaattcttcaacgtagacccaagtaatgcaagatgctcaaataatcttcaagcttatgatcattgtatgtcagagatatactcagagcatattttgttacgaaactgcaaagtagattacgtcttggcagacacaccaaacatcagaaccgatagaagaagagtaatgaaggaattttcagtaaacgattcatcatcattgccacctcctagctgctttacttataggtattttctgtctgccttttgggcaaacgatgaaaatgtacgcagagctctaggcgtgaaaaaggaagtaggaaaatggaaccgatgcaacagccaaaacataccatatacatttgagattttcaatgcagttccttatcacgtaaacaatagtcttaaaggcttccgctctctcatctacagtggtgatcatgattctatggtaccattttcttcaactcaagcatggatcagagctctcaactattccattgttgatgactggagaccttggatgatgagtagcaatcaagtcgcaggctatacaaggacttacgcaaacaagatgacatttgcaaccatcaagggaggaggacacacagcggagtatactccagatcaatgctctcttatgttcagaagatggattgatggagaacctctctaaagattctcactcgcttctctctctttctctctttgttgttgttacagtttaagactaatgttcagtgaattgtaattttgccacatgctattctgtgaaatcttcaatgattttgtgttgttgtagaactctaaagtctaatcagaaaggctctgtttcatagcaagtaacagaccctgtttcatattcc

SEQ ID NO: 11 - DNA, 1248 bp, Arabidopsis thaliana
atgacccataacctttttgcgcctcttgaccttagtttctcctcctcttcatcttcctcctcctctacaaagacttggagatataggagaggctacatagagccttggtggagaccaaacattacaaaaggatatgtcttcctcgaaagaccacctggccctgatctcttgccttggcctcaacaatctcctcccttctctgtcaacaaagagtcattcatcacaaacaaattcaagactcagatccgccttttttattcgcttcaagagtcttttaagaaggcgtccaaagagacaagatggtttgtgataggagatgatgatactctcttcttcttggacaatttggtgaaagctctcgaccgatataaccacaagaagcactattacgtcggaatgaactccgaaaacgtttggtccaacgcgattttcgcttttgacatgggatatggaggcggcggatacgcattgagctatccaaccgtagtaacacttctcagcaacatggaagaatgtatcaaaagataccttggagtttacagcgatcttctctcatttcgttgcttggccgacttgggaattgatcttactttagagaaaggcatgcaccagaatgatctacacggtgacatatcaggtctgttatcagctcatcctcagtctcctcttatcagcctccaccatttcgatgtaatagacccgatattcccaggcatgaaccgccagcaatccgtgaaccacctcatggaaaccgcgaaaaccgaccagtcccgtgtcttgcaacaaacaatatgttaccaaagaggatataactggtcagtctctgtctcttggggctactcagtccacatttaccaatctatatacccaagaagccacctgaaacgccctctcgaaacattccgaccatggaaggatgttagaataccggcgtatggatttaacactagacgggtgacgaatgatccttgcgaaatgcctcgtcagtttttctttgattcagttgtggaagacaagaaccaaagcttggtaactaccatctacaagatgaaaatggaaaggcgtttgcctccttgtttgctaaatggcaaccattcttctcgtaacattacacaagtccgagtcattgctactactatgcacaagatggttgagggaatcgaatgttgcgatgtgcaaaatgttaacagtacggagattttggaagtgaagataagagattgtcatatagatgaagctcttgcttag

SEQ ID NO: 12 - DNA, 494 bp, Arabidopsis thaliana
caaatcaatctttgttgtttgtatcactttattggttgttctatccccaactctaaatgctaaaatggtgacttacccgaatggtgatagacactgtgtaatggcccaaggccaagtgataagtgcatgcttgcaacaagccaacggactaccacatgcggattgttgctatgccataaacgatgtaaacagatatgtagagacaatctacggtcgtttagctctttgcaaatgtttccaggaaattctaaaagattctcgatttacaaaacttattggtatgcctgaaaaatgtgccattcctaatgctgtgccttttgaccccaaaacggattgtgacaggtttgtagaacatatttggcttaaaatgttttgaattatttgcactatctcgatagaactttaagattttctttgtaaataaagttctgagaaggttaaaaaattgatggttatgtaaaatttcattgattttaaaaagagaatattacgtg

SEQ ID NO: 13 - DNA, 245 bp, Arabidopsis thaliana
atggatctacaacagtccgaaacagatgataaacagcccgaacaactagttatttacgtctgcggagattgtggacaagagaacattttgaagcgtggagatgtgttccaatgcagagattgtgggttccgtattctctacaagaagcgtattctcgacaagaaggaaacccgtataggtgtttaatacccagctgtctgagtgccacaactcctgaagattgttcaaaatagacttattgccag

SEQ ID NO: 14 - DNA, 1103 bp, Arabidopsis thaliana
caaaagttgaaaaataccagctcattcacttatgactcatgagtaacttcttccttataaattcaaattgttcacaacttccttgagttccatttccgaacacaaacacacatcatacgtatatttgtcactaataaacatataaaggaatatgagaatcagctgcaacgggtgtagggttctacgcaaaggttgcaaccaagattgcaccattcgaccatgccttcaatggatcaaatccgcagactctcaagccaatgctacactcttccttgctaagttctacggtcgagccggtcttcttaacctcatcgaatccggtcctgatcaccttcgtcccgcaatatttaggtcacttctgtacgaggcttgtggtcggatcgtgaaccctgtagatggttcggttggtttgatgtggtcagggaactgggctcagtgccaagcagctgttgacgccgtgctcaacggcttacccataactcacacacctcttccaagtgcatccgcgtcgcaccagatcattcctccccacaggacttacgatatacgccacgtggctaaagatccaacaaccggcggcgacagttcggagaatctggccacacgtgtaaacgctaacaagagcaagacgcaaactggccgattcaaacgtgaatccgtgaaccaactaggtgaatgtagtcatgacatgtggcaactcccaagttctagtgctacgcatggttatggccacttcacgttggagaatgtggagagccgaagggaagctccatttaatcaaagttctccaaatcttgggtttgatgatcaagtcgatatcaacgaggttggcttagagctcagacttggttagaaccagaagattgcattattattatcataattctgtctttttaattaataatttcactttctatataaaaggagaaaaaaaaactaaagcaaatcaaatttagtattattgtcaatcattaggttatcataaactcactctgtttcaaattagttttttttttctcttttgtccttaattaatatattattttatatgatattactttgttatgaatgaaaagccatgcaggactaaatacaattatttc

SEQ ID NO: 15 - DNA, 2807 bp, Arabidopsis thaliana
tcatgtccaccgttaatcatcactgcctcctcaattttcctcatatcccaccttcaattcctccgaatcatcgtcccaaacttctttcttctctctccctctatcgaaaaccagaacgcctctttgctctctctgcgtctctgtctctttcaccagcaacaatccatgaatgttcttcttcctcatcttcttcttcttcatcgttcgataaagaagaaacggaagacattgaatctgttattgatgggtttttctatctgcttcgattgtctgctcaataccacgacgtcgaggtaacaaaagctgtgcacgcttcgtttcttaagctcagagaagaaaaaacccgtcttggaaatgcccttatctctacttatctcaaacttggtttccctcgtgaagctattctcgtcttcgtgtctctgtcttcgccaacggtggtttcttacacagctcttatctcgggtttctcaaggttaaaccttgaaattgaggctcttaaggttttcttcaggatgagaaaagcaggtcttgttcagccgaatgagtatacttttgtagcgattttgactgcttgcgtgagagtttcccgattctcgcttgggattcagattcatggattgatagttaaatcagggtttttgaattctgtgtttgttagtaattcgctgatgagtttgtatgataaggattctgggtcttcgtgtgatgatgtgcttaagttgttcgatgaaattcctcagagagatgtggcgtcttggaacactgtggtttcgagtttagtgaaagagggcaagtctcataaagctttcgatttgttttatgagatgaatagagtcgaaggatttggagttgatagttttacgctttcaacgcttttgagctcttgtactgattctagtgtcttattgagaggtagagaactccatggtcgtgcaattaggatagggttgatgcaggagttgagtgtgaacaacgctctgattgggttttattctaaattttgggatatgaaaaaggtagagagtttatacgagatgatgatggcgcaagatgctgttactttcacggagatgatcacagcttacatgtcatttggaatggtggattccgctgttgagatattcgcgaatgtaactgaaaaaaacactattacgtataatgcgctcatggctgggttctgtagaaatggccatggcttgaaggcactaaaattattcactgatatgctgcagagaggtgttgagttgacggattttagtttaacaagcgctgttgatgcttgtggtttagtttcagagaagaaagtaagcgaacagattcacgggttttgtattaagtttggaactgctttcaacccttgtatccagactgcattgcttgatatgtgcacaaggtgtgaaaggatggcagatgctgaggagatgtttgaccaatggccttctaatctcgatagctcgaaagcaacgacgtctataatcggtggttacgctcggaatggcttacctgataaggctgtatcgctattccatcgcactctctgtgaacagaagttgtttttagatgaagtttcgttgactttgattcttgcggtctgcgggacattaggttttcgggaaatgggttatcagatccattgctatgctcttaaagctgggtacttttctgatataagcttgggaaattctttgattagcatgtacgcgaaatgttgtgactcagatgatgccataaagattttcaacactatgcgagaacatgatgttatttcttggaacagcttgatttcttgctacatccttcaaagaaatggtgatgaggcactggctctatggtcgaggatgaatgagaaagagatcaagcctgacataatcaccctcactcttgttatttctgcatttcggtatacagagtcaaataagcttagtagctgccgtgatctgtttctctccatgaagactatctatgacattgaaccaacgactgaacattacactgcattcgtccgtgttcttggtcattggggtcttcttgaagaagcggaagacacaataaactcaatgccggttcagcccgaggtctctgttttgagagctctgcttgatagctgcagaatacattcaaacacaagcgttgcgaaacgagtagcaaagcttatactatctacaaagccagaaaccccgtctgagtacatcctcaaatccaacatctactcagcttccggattctggcatcgctctgaaatgataagagaggaaatgcgggaaagaggttaccggaaacatcctgctaaaagctggataatccatgagaacaaaatacattcctttcacgcgcgtgacacatcccacccgcaagagaaagacatatacaggggattggagatactgataatggaatgtctgaaagttggatacgaaccaaacacagagtatgttcttcaggaggttgatgagtttatgaagaagagtttcttgtttcaccacagcgcgaaactcgcagtgacttatggaattctctcgagcaatactcggggcaagccggttcgggttatgaagaacgtaatgctctgtggtgattgccacgagttcttcaagtatatttcagttgtggtaaaaagagagatagttttgagagattcctcagggtttcatcattttgtgaatggcaagtgttcttgtagagatctgtggtgaatcgaccaagacccttagtttttgtaatgttttcttttataaattcgtaagttgttaatacgagagttttggttctgatagctacatagtccattcaaagtttcaaataaaaaa

SEQ ID NO: 16 - DNA, 1008 bp, Arabidopsis thaliana
atggatatctttgtgagttttgttgtgtttatcctttcagtgttatctgttgaatctactatacatatgaaatccatcaagttgggtaaaaatgttatttacgactgcatggatatttataagcaaccatctcttagtcatccattgctcaaacatcataatattcggatgaaaccaacaggatgggattctcaatcagagaataaatttgcagaaagaagacacaacaataaaatagaatgtccaaatggaaccgttcctattttaagagccaaggaaaaacatgtcatacaatatcaagaataccccatcaataattttaccgttcttacagctaaatatccgggtacccatattgcgggaatgaaagtagtagaaaaacataattacagaggcgtagaagcagggctaaggacttataacttgataattgataaaaatcaaagtacaagtgctcaagcttatgtagccagagcattcagtggtgatgccaattctattcaagttggatggatgatcaatgaacaactatttggcgacaaacgaccatggtcgtatgggacatggctggggaaacatggaacaggctgttttaatgtaaaatgtccaggatttgttcaagtagccaaaaatggtccaataagtgtacctctcaagtttgattatcttctctggcttactatacatcaggagttgtttaatcttctaggagatggtgctgatttcgttggatttggaggaatggtttcaggtgatccaagaactccaagcccaccgatgggtaatggtcgtcttccaaacaaagatgaccgtctatggtctggttatcttgaccatcttaccataatccaaccggactatgaacatgccggatttaattaccctatgacagagcctttggtggacagcaacgtatgctatgatgttaatttagtaggatatgttgatcatcaggttggtattgctatgtcttatggtggtcctggaggtattaaatgcggtgattaa

SEQ ID NO: 17 - DNA, 872 bp, Arabidopsis thaliana
attacaaagaaaataggtaaaaacaatttctcattagcttacaatggcggatacacaccgtgtcgaccgtactgatagacactttcaatttcagtcgccctatgaaggcggccgaggtcaaggtcagtatgaaggtgaccgtggttacggtggtggcggttacaagagcatgatgcctgaaagtggcccatctagtacccaagtattgtccctgttgattggagtccctgtcgtcggttcgctacttgccttggctggattacttctagctggttcggtgatcggcttaatggttgctttaccactatttctcctcttcagcccggttatagtcccagcggctctaactatcgggcttgcaatgacaggctttttagcctcggggatgttcggtctaaccgggcttagctcaatctcatgggtcatgaactatcttcgtgggacaaggagaactgtgcctgagcaattggagtatgctaagaggagaatggctgatgcggttggctacgcaggacaaaagggcaaagaaatgggccagcatgtgcagaacaaggcccaagatgttaaacaatatgatatttctaagccacatgacactaccactaagggtcatgagactcaggggaggacgacggctgcatgatgagttttcagtatgaacggtagatatgtgttttcactattatgtcgttttttctgcattttcaatatgatgttatgtgttttttttgtttggctttttgttgaaccgtgtatgtgttttatgtttttgtaagcatgaaagatcgcaagtgttgtggtaatatttgaatgtaataatatgataagttgataaatcatgggaacatttaaattaggtggacatgtttagc

SEQ ID NO: 18 - DNA, 1844 bp, Arabidopsis thaliana
ttcatatatggcttatttttaaaagaagaagaacacaaaacagtagagagagaaagagatatagagatagagagagatagggctttgagattattctcttccacgcaaagaagaagatctaaagatgtcgtcatcatcatataacacaagcgttattccttcatcatcatcctctgctcagcctttcttcatcaccagctccggcaccggagataacgactttaaccggaaagatacttttatgtcaatgattcaacaacctaactcctcagctccaccacccaagaaacgaagaaaccaacccggaaacccaaatcctgatgcggaagtggtagcattatctccaaagacactaatggctacaaacagattcatatgcgatgtatgtaacaaagggtttcaaagagaacaaaatctacagcttcaccgaagaggacacaatctcccatggaagctgaaacaaaaatcaaccaaagaagtgaagaggaaagtgtatctttgtccggagccaacgtgcgttcaccatgacccgtcacgtgctctcggagacctcaccggaatcaagaagcattattaccgtaaacatggcgaaaagaagtggaaatgtgagaaatgttctaagcgttacgctgttcaatcagattggaaagctcactctaagacttgtggtactaaagagtatcgatgtgactgtggtaccatcttctctagacgtgatagttacatcacgcatagggctttctgcgatgcattgatacaagagactgcaagaaaccctaccgtgagctttacgtcaatgacagctgctagtagtggtgtcggctccggcggaatctacgggagacttggcggtggcagtgctctctcacaccaccatttgagtgaccatccaaattttggatttaaccctctcgtgggttacaatctgaacattgcatcttctgataataggagagactttattccgcaatcatcaaaccctaacttcctaatccaaagcgcttcgagccaaggaatgttgaatacaacgccaaacaacaataaccagagtttcatgaaccagcatggtctgatacagtttgatccagtcgacaacatcaacctcaagagtagcggcaccaacaacagcttcttcaacctcggattctttcaagaaaacacgaagaactcagagacgagtcttccttctctatatagcaccgacgttcttgttcatcaccgtgaagaaaacttgaacgcgggttctaacgtgtcagccacggcactacttcagaaagctacacaaatgggttcagtcacaagcaacgacccatctgctttgttcagaggcttagcttcttcgtctaactcatcaagtgttatcgctaatcactttggtggaggacgaattatggagaatgataataatggaaaccttcaaggtctaatgaactcattagccgccgttaatggaggtggcggatccggtggcagtatcttcgacgttcaatttggagacaatggaaatatgagcggctcggacaagttaacgttagattttcttggagttggaggaatggtgagaaatgtaaatcgcggtggtggtggtggtggtcgcggcagtgctcgtggcggagtttctttggatggtgaggcgaagtttcctgagcaaaattatccatttggaagaggttgataatatcttattattgtataacttaattaggtgataattttgttatcttcgcttgttgttttcataatcactatataataatagtatatctttagtgagagctttttaggtttggatttggttagagtctgtcttttatataataaaaaagattgtaagtttgctagct

SEQ ID NO: 19 - DNA, 419 bp, Arabidopsis thaliana
agagacaaagaagttggccatggcaacgaagtcagtttctaccttcgccatctttttcatcctcgttttggctatctttgaaactcctgagatagaagcgtatgataggaagtgcctgaaagaatacggcggcgatgtgggtttcagctactgtgcacctcgaatattcccgacgttctgtgatcagaactgccgtaagaacaagggcgcgaaaggtggagtatgccgttgggaagagaacaacgctattggtgttaaatgcttatgcaacttctgcagcgaggaaccctctgatcaaactctaagtcgtatttgaatcttgcatgtgtcatggtttgtgtaacaaatcaaggtaaatggtccaagtaacaatataataatgaataagcgaaataaagaaaataatatgaaatacaaga

SEQ ID NO: 20 - DNA, 478 bp, Arabidopsis thaliana
gaagttggccatggcaacgaagtcagtttctaccttcgccatctttttcatcctcgttttggctatctttgcagaaactcctgagatagaagcgtatgataggaagtgcctgaaagaatacggcggcgatgtgggtttcagctactgtgcacctcgaatattcccgacgttctgtgatcagaactgccgtaagaacaagggcgcgaaaggtggagtatgccgttgggaagagaacaacgctattggtgttaaatgcttatgcaacttctgcagcgaggaaccctctgatcaaactctaagtcgtatttgaatcttgcatgtgtcatggtttgtgtaacaaatcaaggtaaatggtccaagtaacaatataataatgaataagcgaaataaagaaaataatatgaaatacaagactttgcttgtgttaagaacttaatatgcatgtcatcttttgactaaattaatgactatatttgcg

SEQ ID NO: 21 - DNA, 1137 bp, Arabidopsis thaliana
agacataaattattagagagacgaaaggaaaagcatgtttaaactctgtctcgttctcgtcttggttattgcagtagatgcaaatccggctaagtccggttcttgtagttgctccgggaatatatcagcgagcgatgtcgatcgagttcatttcgcgatgaacttggagttcaccgaggccgagttcttcttaaaaggggctaccggaaaaggacttgatgcctataacgcgacacttgctaaaggcggaccaccgccgataggggccaagaaagccaaccttgatcctataactaatcgaatcatcgaggagtttggttatcaagaaatcggtcatcttagggcgattacggatatgacgggaggaattccacgtccgctaataaatctgacgagagagaatttcgcagtgtttatggatagagcggttggacgcaaatctaatccgcggtttgatccttacgccaactcactcaactatctcttagcttcatattatatcccttatgttggccttaccggttatgtcggaaccatcccttaccttgtctacttcaatatcaaaaagctagtggcgggtctattgggggtggaatcgggtcaagacgcagtgataagaacgcttctgtacgagagacagaatgagaaggtggaggaatacggtggagtcacggtggctgagctgaccaatgagatatctaacctccgtaatgaactcggtatgtgcgggatcaaggacgaaggcttgtgcgtgccgttgtggctaggagcggagaatcgcaccaccagcaacatcctctccgctgatccttactctctctcttatgaccggacagcacaagagatcctcagggttatgtacggcaccggtgatgagcaccgacctggcgggttttggccgtgtggtgccaatggaaggatcgctaggatgtttcttgatgaagggtgttatggtgaatattgcgttgtatgttcacatgacaattaaaagtttccattgatacaattcactagaaaataaaatcgtgattaagattgtaatagtgatctcattaatttaatactggtgattattagtccatgtatttattgctatcgaagtttaataaataaataaaaccgtgttgccatttttgt

SEQ ID NO: 22 - DNA, 2286 bp, Arabidopsis thaliana
atgagagtcccactaatagatttcttgagattcttagtactcattctttctcttagtggtgcttcagttgctgcagatgcaacggtgaagcaaaactttaataagtatgagactgatagtggtcacgcacatccgccaccaatttatggtgccccacccagctacacaacaccaccaccaccaatttacagtcctcccatatatccaccaccaatacaaaagcctccgacttatagtcctcccatatatccaccaccaatacaaaaacctcccaccccaacttatagtcctcccatatatccaccaccaatacaaaagcccccgacaccaacttacagtcctcccatttatccaccaccaatacaaaagcctccgaccccaacttatagtcctcccatatatccaccaccaatacaaaagcctccgacaccaagttatagtcctcctgttaaaccacctccggtacaaatgcctcctacaccaacttatagtccccctataaaaccaccaccagtacataagcctccgacaccaacttacagcccccctataaaaccaccagtgcataagcctccgacaccaatttacagtcctccaatcaagccaccaccagtgcacaagcctccgacaccaatttatagtcctccgatcaaaccaccaccagtgcacaagcctccaacaccaacttatagtcccccggtcaagccaccgccagtgcataaacctccaacaccaatatatagtcctccaatcaagccaccaccagtgcacaagcctccaacaccaatttacagtccccctgttaaaccaccacctgtgcaaacgcctccaacaccaatatacagtcctcctgtaaagccaccaccagtgcataagcctccaacaccgacttacagccctccagtaaaatcacctcccgttcagaagcctcctacccctacttatagtcctccgattaagccaccaccagtgcaaaagcctccaacaccaacttatagtccaccaattaaaccgccaccagtgaagcctccaactccaatatacagtccacctgtgaagccaccaccagtacataagcctcctacaccaatttatagcccacctgtcaagccaccaccagtgcataagcctccaacaccaatttacagccctccagtaaaaccacctcccattcagaagcctcctacccctacttatagtcctccgattaagccaccaccacttcaaaagcctccaacaccaacttatagtccaccaattaaactgccaccagtgaagcctccaactccaatatacagtccacctgtgaagccaccaccagtacataagcctcctacaccaatttatagtccacctgtcaagccaccaccagtgcataagcctccaacaccaacttatagtccaccaattaaacccccaccagtgaagcccccaacacccacatacagtccacctgttcagccaccaccagtgcaaaaaccgccaacaccgacttatagtccacctgtcaagccaccgccaatacaaaaaccaccgacgccgacttacagtccacctattaaaccaccaccagtgaagcctccgacaccaacatatagtcctccaatcaagccaccaccagttcataagcctccgacaccaacttacagtccacctatcaagccacctccaattcataaacctccgacaccaacttacagtccacctatcaagccaccaccagtgcataagcctccgacaccaacttacagtccacctatcaagccaccaccagtgcataagcctccgacaccaacttacagtccacctatcaagccaccaccagtgcataagcctccgacaccaacttacagtccacctatcaagccaccaccagtgcataagcctccgacaccaacatacagtcctcctatcaagccaccaccagttcataagcctccgacaccaacatacagtccacctatcaagccaccaccagtgcaaaagcctcctaccccaacttatagccctccagtaaagccaccaccagtacaattgcctccaaccccaacttatagccctcccgtaaaaccaccaccagtacaagtgcctccaaccccaacttatagccctcccgtaaaaccaccaccagtacaagtacctccaacaccaacttatagccctcccataaaaccaccaccggtacaagtgcctccaacaccaactactccatcacctccccaaggtggatacggtactcctcctccatatgcatatctatcgcatcctatagacataaggaactag

SEQ ID NO: 23 - DNA, 1700 bp, Arabidopsis thaliana
ctaatcaattactttcctcgttatccttttttgcagtcaagttaaattgctctctttcaagacttgtgttctttaaaccaaaaaaaaaaaaaaagtatctgtgttcatcaccaactcattcttctttcagatctagggtttcatgcttcactcaatttttttttgtttaggtagttccatcttctaaacgttgtatttttttttttttgccatcataatcatatggagttcgagtcagtgttcaaaatgcattatccgtatctcgcagccgttatctacgatgatagctccactttaaaagattttcatccatctcttaccgatgatttttcttgtgtacacaatgtgcatcacaaaccatcgatgcctcacacatatgaaataccatcaaaagaaaccattaggggcatcactccttctccatgcactgaagctttcgaggcatgttttcatggcacatccaacgaccatgttttttttggcatggcctataccaccccaccaactattgaacccaacgtttcacatgtctcacatgacaatactatgtgggaaaacgatcaaaaccaaggattcatctttggaaccgagtcaaccctcaatcaagccatggcggactctaatcaattcaatatgccaaaaccactcttgagcgcaaacgaagacaccatcatgaatcgacgtcaaaataaccaggtaatgatcaagaccgagcagatcaagaagaagaacaagagatttcagatgaggaggatatgtaaacccacaaaaaaagctagcatcatcaaaggacaatggactcctgaagaagacaagttattggtgcagctagtggaccttcacggaactaaaaaatggtctcagattgctaagatgcttcaaggacgagttggaaaacagtgcagagaaaggtggcataaccatctccgtcccgatatcaagaaagatggatggactgaagaagaggatataatactgataaaagcccataaggagattgggaacagatgggctgagatagctcgaaaactcccgggacgcactgaaaatacgatcaagaaccattggaacgcgactaaacgtcgacaacactcgaggaggactaaaggaaaagatgaaatttccctttcacttggtagcaacactcttcagaactacattaggtctgttacctacaatgatgatcctttcatgaccgcaaatgcaaacgcaaacattggtccaagaaacatgagaggtaaaggtaagaatgtaatggttgcggtctcggagtatgatgagggtgaatgtaagtatattgtggatggtgtgaataacttgggtttagaagatggaaggatcaagatgccgtcattggcggctatgtcggcctccggatcagcgtctacttctggttctgcgtctggttctggaagtggtgtgaccatggagattgatgagccgatgactgatagctggatggtgatgcatggatgtgatgaagttatgatgaacgagattgctttgctggagatgattgctcatggtcgtctttagaccgtgcaatataaacaagtcgaacttgattatatctacctatataattatgctatttatgaaattatgtttgtgcttttaattgaagaattggacatgtaatatatattgtggtttaattgaaggtttcttttggactaaacaaaaattgaaggttttcttgc

SEQ ID NO: 24 - DNA, 696 bp, Arabidopsis thaliana
atggcgttgctctgtcatcatcaatccgaagttcaagcggcgcagaaaccaagtcctgttgcttgctggtcgtcaataaacaaggttcaaggttgtgtggatgctgtgaaagctgccactaaaggagattataaaggtttgagcaaggattgttgcctcgccatctatggcctcatcgacgattgttttccgattgttttcagcggaaaaccagacattgcagtactcgttaaggatgcatgtgctatggtaactttcaggttacaaaacttggagagaaagattgattcaactatggatattatcgcagaattaaggcaaagagaatcagtttatagaacagcttttgttcttacaaaggcagagactgaagtaaaacagtttgtgattaaaacaaaaatgggaacaaaacagatcgtcacagtgatgttcttctttttatctgtgatcatggcgttgctttgtcatcatcaatccgaagctcaagcgccgattccaactcccggtgattgcttctcgtcaatcaagaaggttaaaggttgtgcggatgctgtgaaagctgccactaaaggacatcttctacgtttggtcaaggattgttgccacgtcatcaatgaccttgccgacgattgttttccgatcattttccccggaaaaccttacattgccgcactcgttaagcatgcatgttcttaa

SEQ ID NO: 25 - DNA, 1217 bp, Arabidopsis thaliana
cctctgactggaaaaagcttcctcagatcgtttcatcgtccaagcggaagaagcgtctccttcaatcaccgtggacacctccgagactgtctccgattgaatgggaattgaagacatgcattcaaaatctgacagtggtgggaacaaggttgattcagaggttcatggtacagtatcgtcgtcgataaatagtttaaacccttggcatcgtgctgctgctgcttgcaatgcaaattctagtgtggaagctggagataaatcttctaagtcaatagcattagcattggaatcaaacggttccaaatcaccatccaatagagataatactgttaacaaggaatcacaagtcacaacgtctccacaatcagctggagattatagtgataaaaaccaagaatctctgcatcatggcatcacacaacctcctcctcaccctcaacttgttggccacacagttggatgggcatcctcaaatccataccaggatccatattatgcaggagtgatgggagcctatggacatcatcccctggggtttgttccatatggtgggatgcctcattcaagaatgccactgccgcctgagatggcacaagaaccagttttcgtgaatgctaaacagtaccaggcgattctgaggcgaaggcaggcacgcgccaaggcagagctagagaagaagctaataaaatccagaaagccttatctacatgaatctcggcatcaacatgctatgaggaggccaaggggtactggaggacggtttgcaaagaaaaccaacaccgaagcttcaaagcgtaaagctgaagaaaagagcaatggtcatgttactcagtccccgtcatcatctaattctgatcaaggtgaagcttggaatggtgactatagaacacctcagggagatgagatgcagagctcagcttataagagaagggaagaaggagagtgttcagggcagcaatggaacagcctttcctcaaaccatccttctcaagctcgtctagccattaaatgacctcacaaggcggcaattcattcttggctttctctttgttggcttattcggtagcagccatgaaagagtattttctctcgtttttttttcttctgattttgtacaaatactttttgtagctttttgtgactttttccctttcagtttggaatacttcagatgttgccacttttctttttcaattctatcttaactaaacatttct

SEQ ID NO: 26 - DNA, 1710 bp, Arabidopsis thaliana
gagctggctcttgtcttgtctactttcattacagtgactctgcatgcttcagactgatttcagcaacatgcatgggcttaaaatcagcttctaagactgagatttagtgaccagtgtggtggtgtcttgttctctgttcttgggagaacacaaaggcagtgtggagtctggtaaaatatgatacatggtttgccatctatgaagtctatcaaatcattgaagtcacttgttaaaagaaaaaccaatgctcaagaagtgagtaaatccgggtggaaaatgaagccctttttggctctcatgtgtacagctcttttgatcttttggtataagaccacaaatattcagtttgaacaaacagagatagaagaaacagattatccttttgacatggctaaggaatctgaagcagttaacgataaattaaaaggcttgcctcgtggaatcatacagtctagatcagatcttgaattaaagcctctctggtctagaggtagtctgaggtcaaagggtgtggaaatgactaaccgtaacttgttggcaatacccgtaggacttaagcaaaagggtaacgtcgacgctcttgtaaagaagtttcttcccgcgaatttcacgattgttcttttccattatgatggaaatatggataaatggtgggatctggagtggagttcaaaatccatacatatagttgcacaaaaccagactaaatggtggtttgcaaaacgattcctccatccggatgttgtatccatttatgattatatttttctttgggacgaggatcttggagtagagaatttcaatccagagagatatttgaagatagttaaatcagtgggactggagatatctcaaccggctttggaccacaactcgactgaaatacaccataaaatcactctccgttctaaaacaaagaaatttcataggagagtttacatcaatagaggccataaaagatgttctaatactagctcagatcctccttgcaccggatttgttgaaggaatggctccggtgttttcgaaagctgcttggctttgcacttggaatcttatacagaatgatttggttcatggatggggaatggatatgaaacttgggtactgcgcacagggagaccgaacgaaaaacgtagggattgtggatagcgagtatatccttcatcaaggcattcaaactttaggtgaaagtgttcctgagaagaagaagacggctcgtgatgttgggaccaggagacaaggccatacaacttttgattcaagaaccgagataaggagacaatcgacatgggagcttcaaacttttaaagaacgatggagcaaagcggtagaagaagacattaagtggatcgatccatcgtcatcaagctcgatgacaaagaggaagagtaacggtaataacagaagattaaggcgtggtagtagtagtagtcaccgagtaaagcataagagaagtcaagagacatcaagaacaacaacaacacacaaatagcaagagaaggattattatacacatagatagtgtttttctttatctcattaaccaatttatatatgattatactacttatccttagttagtatatagctttcttggaattgatgaaaaagggttcatattaagatttgtaaaagctcatgtccattatgtactttcatcactataactactttaaaaatcaaataaagagacccactttcctaactt

SEQ ID NO: 27 - DNA, 2190 bp, Arabidopsis thaliana
aaaaacagtaattactcttcttagatctaaaacaattaataaatctttcccttttttctcatcataattttttcgtatttaactcttgtaaaaatttgcttagccgtttcgctttctcaggccccaggtgattcgtgtcttctaggtcagcttgtgaaacctgagagaagccatcttttgtttgcggttacaaactttgccgcttcaatatttcattgctgttttctgggaaaacctttttctagttttttcggcttattatgccttttaactttttgtgcatttaacatttattgttagtgctttgcttagtgtaaagtagtagttctctttgtaatattaccataaggttcagaagtaaatttttctaaaattgttttcttgtgggaaattcagactgatttcagcaacatgcatgggcttaaaatcagcttctaagactgagatttagtgaccagtgtggtggtgtcttgttctctgttcttgggagaacacaaaggcagtgtggagtctggtaaaatatgatacatggtttgccatctatgaagtctatcaaatcattgaagtcacttgttaaaagaaaaaccaatgctcaagaagtgagtaaatccgggtggaaaatgaagccctttttggctctcatgtgtacagctcttttgatcttttggtataagaccacaaatattcagtttgaacaaacagagatagaagaaacagattatccttttgacatggctaaggaatctgaagcagttaacgataaattaaaaggcttgcctcgtggaatcatacagtctagatcagatcttgaattaaagcctctctggtctagaggtagtctgaggtcaaagggtgtggaaatgactaaccgtaacttgttggcaatacccgtaggacttaagcaaaagggtaacgtcgacgctcttgtaaagaagtttcttcccgcgaatttcacgattgttcttttccattatgatggaaatatggataaatggtgggatctggagtggagttcaaaatccatacatatagttgcacaaaaccagactaaatggtggtttgcaaaacgattcctccatccggatgttgtatccatttatgattatatttttctttgggacgaggatcttggagtagagaatttcaatccagagagatatttgaagatagttaaatcagtgggactggagatatctcaaccggctttggaccacaactcgactgaaatacaccataaaatcactctccgttctaaaacaaagaaatttcataggagagtttacatcaatagaggccataaaagatgttctaatactagctcagatcctccttgcaccggatttgttgaaggaatggctccggtgttttcgaaagctgcttggctttgcacttggaatcttatacagaatgatttggttcatggatggggaatggatatgaaacttgggtactgcgcacaggttaccttttttctgtataactcaagattttgtgggagaccgaacgaaaaacgtagggattgtggatagcgagtatatccttcatcaaggcattcaaactttaggtgaaagtgttcctgagaagaagaagacggctcgtgatgttgggaccagggtaagttgtatcgactcaaaaacattctcgattctaattcttttggtcttcactaaataaaactcactccttcgtgtttcttttttttgtcgatatttcaagagacaaggccatacaacttttgattcaagaaccgagataaggagacaatcgacatgggagcttcaaacttttaaagaacgatggagcaaagcggtagaagaagacattaagtggatcgatccatcgtcatcaagctcgatgacaaagaggaagagtaacggtaataacagaagattaaggcgtggtagtagtagtagtcaccgagtaaagcataagagaagtcaagagacatcaagaacaacaacaacacacaaatagcaagagaaggattattatacacatagatagtgtttttctttatctcattaaccaatttatatatgattatactacttatccttagttagtatatagctttcttggaattgatgaaaaagggttcatattaagatttgtaaaagctcatgtccattatgtactttcatcactataactactttaaaaatcaaataaagagacccactttcctaactt

SEQ ID NO: 28 - DNA, 1343 bp, Arabidopsis thaliana
atgtatctctttttaacccttaaaacattggaaacaagaattctcttacacatgtatcggtagttggaaatgccgacccaaaaggaccaaaactcaccattatctcaagtgatagagcttctcaagaaactactccaccatttccacaatctccttttgtatttcttcatcctctggatcggcgtgatagttggaatcattgtttatccctctctacaaggattatcttcgccttcttcgttaaccatccaaagtgtctcccaactcttctttgtaacccctcctcctcctattctttctccttcatttcaggacaatgggcttgacatgtttctgataccactgaagaacatcatgcacgatatggaagataatgaacttctgtggagagcttcaatggatcctaagatcagggattacccttatcctagaatcccgaaggttgctttcatgttcttgacttggggacctttacctttggctcctctatgggaaaggttctttcgaggtcatgaaggtcttttcactatctacgttcacaccaattcgtcttacgacgagttcatgccgcaagactctgtgttttatggccgccgtattccaagcaagagagtggattggggaaacgcaaacatggtagaagcagaacgaaggttattagcaaacgctttattagacatcaacaacgaacgtttcattcttctctccgaatcatgcatccctctcttcaacttctccacagtttactctttcctcatcgactccactctaacccacgtcgactcctacgacctcacaatcggtcgcgtccgctatgaccgccgcatgtatcctcacatccgcatgcaccaatggcgaaaaggctctcagtggttcgagctagaccgagccatggccctcgaggtagtctctgatacgttctactggccaatctttaaagcttactctcgctgccccgacgagcactatatcccgacgctactcaacatgaggccgagccttgggttgcgtaacgcgaataggacgcttacttggactgactggagcaagcgtagggctcacccgagattgtttggtgagtgggaggttaatgtggagttcttggagtggctaaggatgaagagtgttggtgattgtaagaaaaatggagaaaataagatgagactttgctttctctttgctcgcaagttttcgtcgactgctttggatgagttactccggttagcatctatcgtcatgtatttctgatcactctcttcccccttcgtccaaaaacaaagatgcaatcggtttaactaccaaatcttctttaagtaagtgaaatatacagtgtgtgcttaaca

SEQ ID NO: 29 - DNA, 1568 bp, Arabidopsis thaliana
ataaatgtgtgtatatatacatctttggctataaatataaggtcgaaccaaaataaaatatagatttggggaaactaataaatgatatagagaatccacctctctcccttatttttttttcttggtttcttgacctattattattgattagtaatagtgagagaggcatattttggagatacacataaacacataaattggaagaataaaataaaagagagtgagagatggctaaatcagatatgttgccgttcttggcgatggtgttggtgcaaatcggctacgcaggcatgaacattacgtcgaagatggctatggaggccggtatgaagccactcatcctggtcgcttatcgtcagatatttgccactatcgccacttttccggtcgcattttttctcgaacggaagacaagaccgaagatcacacttaggattcttgtccaagtcttcttctgctccattactggtgcgactggaaaccaagtgctatatttcgtaggacttcagaattcatctccgaccattgcttgtgccttaactaatctcttaccagcggtcactttcctcctcgccgcaatattcagacaagaaaccgtggggatcaagaaggcatcaggacaagccaaagtgatagggacgctagtatgtgtgatcggagccatggttctctccttctaccatggtcacaccatcggcattggagaatccaagatccattgggcctacgctgaaaacatcacgaaacatggttccagttctggccattctaatttcttcttgggaccttttcttattatggctgctgccgtttcttgggccgcttggttcattatccagacgaagatgagtgaaacatttgcagcaccgtacacgagcacactactaatgtgtttgatgggaagtatccaatgtggagccattgctttgatctccgatcatacaatctctgattggtctctcagctctcctctccgcttcatatccgccctttatgccggagtggtggcgtctgcgttagctttctgcctaatgtcatgggctatgcagaggaaaggtcctctgtacgtctctgttttcagccctttacttctcgtagttgtcgccattttcagctgggctcttcttgaagagaaactctacaccggcacgtttatgggatcagcacttgtggttattggtctctatggcgtattgtgggggaaagacagagaggtgagtgagaaggaagaagaaagggagaaggtgaaacaacaaaaccataaagtcaagagtgaaagtaatgaagatattgaatcgagattaccggtagcaagtagtggaaatggttccacaaggtctacatcgccttaaaatggtgattgcttcttcatcatatataagtatgagctatggaagaaccttttgggatttcttgttatctaagttactgcaactaaattggattttcggagtgtttaattttgtatcccattttgaggctaatgatggagtgttgatttgtgtgttcatcctatggacaacaaatatcacctgtttgatctctatatatattcagtattcttaatc

SEQ ID NO: 30 - DNA, 766 bp, Arabidopsis thaliana
ctctgccaaagtccaaaggagagtttttctttattactagggcattctctgcagatttcttctccttaagccatggaattgcccccaaaagtgaaaaacatcttgcttttggattctgaaggaaagcgtgtagcggttaagtattactcagatgactggccaacaaattcagctcaggaagcgttcgaaaaatccgtgtttacaaagactcagaaaacaaatgctaggaccgaagtggaagtgacagcactggagaacaacattgttgtgtacaaatttgtgcaagatctccatttctttgttacgggcggtgaagaggaaaacgagcttatcttagccagtgtgcttgagggactctttgatgcagtgacccttctccttagaagcaatgttgataagagagaggcactagacaaccttgatctcatctttctaagctttgatgaaattatcgatggcggtattgttctggagacggatgcaaatgtaatagcaggtaaagcagggatcaatagcactgaccctaacgctcctctatccgagcagacgataagtcaagcactcgcgactgcaagagaacatttgacaaggtcacttatgaaatgatgtgtgttttgctcttcggtaataatggttgtttttgtcatggtgaatgtgtgttttgtctcttgtagttgagtgactatactcttaaatataaaagttactttgcacttgggagatagttaccgttcttaaggtcaaacaattctctggtgatttcttc

SEQ ID NO: 31 - DNA, 297 bp, Arabidopsis thaliana
atggcttcttatgaatcacaaagagatgtcgctgaattggcgacccttgaacaaactaaaaagaatgtggaggatgtcgaggaggttctaaagaaactcgaacaaacttatttggggaaggaaaaagtcacagatgatacgcttttgagtgacgaagaaatggaaaagttcaatcagatgatgaactgtgtaaaacttctgaacaattgtttgacaaagataggacagtcattgccgctaaaagaaggagaaagagaattagttgaagttgaagttgatttcaagaatataccctaa

SEQ ID NO: 32 - DNA, 1780 bp, Arabidopsis thaliana
attgtgaatcatcggagagagtgggaaacatggagaaaaacaagagagctatcggatttttacttctggtcgtacttatcaatggagttatgatgacgagatcaaatgggtatgaaggagaagaagagtggggaggagcaggaggaggagagtggggaggagcagaaggaggaggagcatggggaggaggaggtggaggaggaggagcatggggaggagaaggagaaggaggaggagagtggggaggaggaggagaaggaggtggtggaggaagaagaggatggttcatgatgagagagtcgaggcaagtgatcaaatcagaaggtggagagatgagagttgtgttatcaccaagaggaaggatcattgagaagccaatgcacattgggtttctaacaatggaacctaagaccctctttgtccctcagtatcttgactcaagccttctcatctttattcgtcaaggtgaagcaacccttggagtgatatgcaaagacgaattcggagagaggaaactgaaagcaggagacatctactggattccggctggttctgtcttttatttacataacacaggcctaggtcaacgccttcatgtcatttgcagcattgatccaacgcagagtctcggcttcgaaaccttccaacctttctatataggtggagggccttcgtctgttctagctggatttgatcctcacactttaacttcagcattcaacgtttccctacctgagctgcaacaaatgatgatgagtcaattccgtggcccgattgtatacgtcaccgaagggccacaaccacaaccacaatcgacggtatggacccaatttttggggttgagaggggaagagaaacataagcaactcaagaaactcttggagactaaacaaggatcccctcaagatcaacaatacagttcagggtggtcttggaggaatattgtaagatcgattttggatctaacagaagaaaagaataaagggtcaggatcttctgaatgtgaggactcgtacaacatttatgataagaaagataaaccaagttttgataacaaatatggatggagtatagctcttgattatgacgattacaagcctcttaaacactcggggatcggagtatacctcgtaaatctcaccgcgggagcaatgatggctccacacatgaacccaacagcaacagaatatggtatagttttagctggctctggagagatccaagttgtatttcctaatggaacttctgctatgaacacaagagtctccgtaggagatgtcttctggatccctagatacttcgcgttttgccagatcgcatctcggaccggaccattcgagtttgtaggattcaccacatcagctcacaagaatagacctcagttcctagttggatcaaactcactactcaggactttgaatctgacgtcattgtccatagcgtttggagtcgatgaagagacaatgaggcggttcattgaggcgcagagagaggctgttattctccctacgccagcggcagctcccccgcatgttggtgaaatggttagcgaccgctttgtttgaggaatgtgtgaaagggtttctttttgtatgttatgtatgtagttaaacatgagtatgtatggatgtatgtttttgtttctttgaaataacattaataaaggtgatcactaaagcatgttatgtatgtagttataactatgagtatgtatggatgtatgcttttgtttctttgaaataagattaataaaggtgaccactaaagcatgttatgtgag

SEQ ID NO: 33 - DNA, 1602 bp, Arabidopsis thaliana
gttcatcttttattttagattttattcgaggataatgcgtaacacacaagttatctatgttatatattattaggagagacttttctttactggaacggaacagagccaaggatatgcatctcagatcctgaacttgcaaaaactatgttgtcgaacaagttaggtttctttgtcaaatcaaaggcaagacctgaggctgttaaacttgtcggctccaaaggacttgtctttatcgaaggtgctgattgggttcgccatagaagaatcttgaaccctgctttctccatcgataggctcaagatcatgacgaccgtgatggttgattgtacgctcaagatgttagaggagtggagaaaagagagcactaaggaagaaacagagcacccgaagattaaaaaggaaatgaacgaagagttccaaagactaacagctgatataatagcaacctctgcgtttggaagcagttacgtcgaaggaatcgaagtgtttagatcacaaatggagcttaaaaggtgttatacaacttctctcaaccaagtctctatccctggaactcagtaccttcctacgccttcgaacattcgggtatggaagctggagaggaaaatggataactcaattaagagaattataagttcgagactacagtcaaagtcagattatggagacgatcttctcggaatcttgttgaaagcttacaacactgaagggaaggaacggaagatgagcatcgaagagatcatacatgaatgcaggactttcttcttcggaggtcacgaaactacttcgaatttattggcatggacaacgatgttgctgagcttgcaccaagattggcaggagaaactcagagaagagatattcaaagaatgcggtaaagaaaaaaccccagattcagaaactttctccaaactcaagctgatgaacatggtgatcatggagtcgcttcgactttacggaccagtgtcagctttggcccgagaagcatcagtaaatataaagttaggtgacctagagattcccaagggcacaaccgtagtcatcccgcttctgaagatgcatagcgacaagaccctttggggatccgacgccgacaaattcaacccaatgcggtttgcaaacggcgtttcccgagccgccaatcacccaaacgctctcctagcattctccgtcggaccaagagcttgcattggccaaaactttgtcatgatcgaagccaagactgtgctcaccatgattcttcaacggtttcggtttattagcctctgtgacgagtataagcacacccctgtggataacgtcactattcagcctcagtacggcttacccgtaatgcttcagcctctggaagactgaagtaaaatgcccaaataaatcggatgtcttaatgaatatacctcacgtgtgtgacaagtctcctccatataggccggcttattgctgatggtgggggcttaacaaatcatccttgttaagttattgggcttttactatctcagtttggaacccttgatgggctaaatagttattaataatttaatatattgtgacattgcatgtataattgaaaagtggaaggaagtgtgtaacggttatgaattc

SEQ ID NO: 34 - DNA, 1854 bp, Arabidopsis thaliana
aagaacaacaatacacacacacaaacataaggaaaaaaaaacttttccatggggctcgtaattttcttggcactaattgtcttaatccttattattggtctcaggatattcaaagcttttatgattcttgtttggcatccatttgtgttgaccagaagactcaaaaaccaaggaatctcaggcccaaattacagaatcttttacggaaacctcagcgagataaagaagatgaagagagaatctcatctttcgattcttgatcctagctccaatgatattttccctcgtattcttcctcattatcaaaaatggatgtctcaatacggagagacttttctttactggaacggaacagagccaaggatatgcatctcagatcctgaacttgcaaaaactatgttgtcgaacaagttaggtttctttgtcaaatcaaaggcaagacctgaggctgttaaacttgtcggctccaaaggacttgtctttatcgaaggtgctgattgggttcgccatagaagaatcttgaaccctgctttctccatcgataggctcaagatcatgacgaccgtgatggttgattgtacgctcaagatgttagaggagtggagaaaagagagcactaaggaagaaacagagcacccgaagattaaaaaggaaatgaacgaagagttccaaagactaacagctgatataatagcaacctctgcgtttggaagcagttacgtcgaaggaatcgaagtgtttagatcacaaatggagcttaaaaggtgttatacaacttctctcaaccaagtctctatccctggaactcagtaccttcctacgccttcgaacattcgggtatggaagctggagaggaaaatggataactcaattaagagaattataagttcgagactacagtcaaagtcagattatggagacgatcttctcggaatcttgttgaaagcttacaacactgaagggaaggaacggaagatgagcatcgaagagatcatacatgaatgcaggactttcttcttcggaggtcacgaaactacttcgaatttattggcatggacaacgatgttgctgagcttgcaccaagattggcaggagaaactcagagaagagatattcaaagaatgcggtaaagaaaaaaccccagattcagaaactttctccaaactcaagctgatgaacatggtgatcatggagtcgcttcgactttacggaccagtgtcagctttggcccgagaagcatcagtaaatataaagttaggtgacctagagattcccaagggcacaaccgtagtcatcccgcttctgaagatgcatagcgacaagaccctttggggatccgacgccgacaaattcaacccaatgcggtttgcaaacggcgtttcccgagccgccaatcacccaaacgctctcctagcattctccgtcggaccaagagcttgcattggccaaaactttgtcatgatcgaagccaagactgtgctcaccatgattcttcaacggtttcggtttattagcctctgtgacgagtataagcacacccctgtggataacgtcactattcagcctcagtacggcttacccgtaatgcttcagcctctggaagactgaagtaaaatgcccaaataaatcggatgtcttaatgaatatacctcacgtgtgtgacaagtctcctccatataggccggcttattgctgatggtgggggcttaacaaatcatccttgttaagttattgggcttttactatctcagtttggaacccttgatgggctaaatagttattaataatttaatatattgtgacattgcatgtataattgaaaagtggaaggaagtgtgtaacggttatgaattc

SEQ ID NO: 35 - DNA, 1869 bp, Arabidopsis thaliana
ctcttcaccccaaaatcaacctacaaaagttaaaagttacaccttactaaacacaaacaacttcataatggctttccacttccggcgactttgcttcttctcagctcttcttgccgtggttctccaactccttcatggcgtctctggccaactagttgtggttgaggaacctatttctgctcctccgcctccgctggtcgacctaaacaccggtgatggcattgtgccggcgctgtttgtcttcggtgactctctaatagacaatgggaataacaataacattccttcctttgccaaagccaattattttccttatggcattgatttcaatggcggtccgaccggtcgattctgcaatggcttaacgatggtcgatgggattggtaactcaactattggggctgccactgattccggcctactcggaagctaccggagatcaagtacttcgtggtgtcaactatgcttccgcagccgcggggattcttcctgacaccggaggaaactttgtgggacgcatacctttcgaccagcagattcataacttcgagacaacactagatcaggtggcgagcaagtccggtggtgcagtggccattgcggattcggtgactcgaagcttgttcttcatcggaatgggaagcaacgactatctcaacaattacttgatgcccaatttccctacccgtaaccaatacaactcccaacagttcggtgatctcttggttcaacattacaccgatcagctcaccagactatataatcttggtggtcggaaatttgtagtggccggacttggaagaatggggtgcattcccagcattctagctcaaggaaacgacggtaaatgctcggaagaagtgaaccaacttgttcttcctttcaacacaaacgttaaaacaatgatctctaatctcaaccagaatctcccggatgctaaatttatttacctcgacatcgctcatatgttcgaagacatcgttgctaaccaagcagcttatggtcttactactatggacaaaggatgttgtggaataggaaaaaacagaggacagatcacttgtcttccctttgaaacgccttgtcctaacagagatcagtatgtgttttgggatgctttccatcctacagagaaagttaatctcataatggcaaagaaagcgtttgctggtgaccgcactgtcgcgtacccgatcaacattcagcaattggctagtctcaattaacgattatgaagactatcaacaagacataaaaacttggtgttgtctttgtagtttcttttttgtaaggttttgagtcaaatctgttttccttttaagacgttttgaaaacgtctactgtgtcacacttaacggtccaaatcaatgtactcatcgttgcttcctttgttttcttaaatatcatcaattataaaattacaaaaaacacacaatctttttctttttttttaataaatcacactaatcctgaagcctatggagcttcggagattcagttcttgatatgtatttaagcatcatccaaccagaaattgtttataccggcggatagggttaaggacagaatttaacgccggagacaccatagttacggtgactaggcaccgtgaaatgacggagtcttccctcttgcttcgtcatgtaatctctacacaaaaactccattgagaactcatcctccactttcctatccacatcatgcacaaacacagccgttgtctcttcctcatccttccgtctcctcgcgatcatccccgccgtgtaaatcgccgacatccgtcccggagcttcttcatgaaaccccgtcggagcatccaccatgattagatcccactctgtctcgtaaaccacctccggtaagcccttc

SEQ ID NO: 36 - DNA, 2313 bp, Arabidopsis thaliana
actcctcgaccatgtgtatatataccatcgctaacttaagacatatatcaatcaatcccacaaacctaaattgaaaacaaatatatttccacctgaaacaacataaacagaatggaaccttcaaaacaagaagttccaaagctcatggagacaccaccgaacatatcaaacgattcatcagcaaccgagaaaggagaagcaacaaggcaacaacagctaccaaacaataggtacgcactcacagttgacgaggtgatcgagcaacacattggagcacttgggtttgctcagatcttgcatgctctcttggtctctatcgcttggatcttcgatgctcagaccactcttatatccattttctccgatgctcagcccgcggcgaggcttcttgcaaccggtgccatcgtggagggtgcctccttgtgtggattggccagtggagaatgggaatggattggaccaaagagtgacactgttgtttctgagtggaatctcatatgtcaacataaatttcttgtggctgttccttccacactattcttcatcggatctcttttcggttctggtgtgtatggatatcttgctgattcatggtttggtcgaaagaagactttattactctcttgtgtattaactttcgtcacggcctttgcgatctctttttcaccaaacgtttgggtttatgcattcttgcgttttgccaacggtttctttagatcaggaattgggtcttgttgtatcgtactcgcaactgagattgttggcaaaaagtggcgaggccaagtagggcaatacggtttcttcttcttcacgttaggttttctatctctaccactcatggcttacttggagagaaagtcctggagaaatctttaccggatcatatcctttcttcctcttggatacgcggtttgtctcctgccctttgcttatgagtctcctcgatggcttcttgtcaagggacgtaataaagaagccatggtggtcttgaagaaactcgcgaggctcaacgggaaacaacttccggcggatctaagcctagtcgatccaattccagagagagatgatcaaacttcatcatcggagaagttttggaaaacaaaatgggcagtgaaaagaatcataatggttatgatggctggatttggcagtggctttgtttattatggaattcaactaaatgctgaaaatctcaacttcaatctttacttaactgttgctgttaacgctctgatggagtttccagcggttttcatcggaagcttcctcctcggggtcatgaaccgccgtccactattctcgaattcatcatacctcgccggattcgcgtgtctgctctgcgcggttctctcgatccaccgcgtgatccgtgcgatatctgtggcaaaatggttacaacttgcagttgaggcggttgggttcatggcatcctcgacagcgtatgacgtcctatatgtctactgcgtagagctgttcccaacaaacgttaggaacactgctgtctcacttttgcgtcaagcgtttatgctaggagcgtctgcagcaccactgctagttgcgttaggaagggaaagcgcaatgatgtcgttcatcgtgtttggtgttgcatcagtgctgagcggcatcgtgagtctctggctacgagaaactcgaaacgctccgctttacgaaacactagcacaacaggggaaagcggaagagatcgaaaacgaaacaatcatgattacttgattgcattcagagtgttgtatttctatggaatgtttacatccaataattggaaatatgtaaaatctttggaatttccatttaaatgtacgaaactgttgattgttcatctcaagacatcgttgactcaaaacaaaggactgtgttgcaagaagtgtatgaagcgacaggacatagtagtactcatttgaacaggtggtaaacaaaaagcgatctaaccttaataaaaggaaaattgctgttcggaccaaaaagcatcaagtgataataaaaccaagtctttctgttcgcaagcattagagaaaacaagaatctgacagtgctcagaagaggtcgagcgacaaacatttttatgatgggttttgcaggtgagctcttctccttcttcttcctcctcctctaagaagcagcagctttgggagcctcttcagtagcaggggtctcgaaagtctctcccactacaagatctgggacatcatcatcatcgtcctcttcttggattgttgctgggacatcacctgcacctggagcttgtttctggaattgctctgctagcttcttcaggttgtccaagttatctggtcc

SEQ ID NO: 37 - DNA, 800 bp, Arabidopsis thaliana
ctccatatgtctcatgcacacatctctccctctctttccttccctctctctctctcactctcccaagacaataatgccaaacgcgggatctgagcgggcagcttcactctcactgaaaaagcaagacaccgccaccttctccggtaagctaccgtcgaccaaacaacgtttttcgtcggtatcagctgcttgtccttcctttagaatctactactacgacggagccgccggtgccgtccctttcgaatgggaatctcatccaggcacacccaaacacccctcctctgagctacctactctgccacctctcactcctccgccgtctcatttctctttctccggcgaccaaatccgccgccgttccaaaaagtccaccaagaaaatcctcgcactaatcccgacaaggctcttctggctatcgggcgatcacaatggtaaggctaagaaactgtcggcttcatcaccaccatctctgtcggagagagtgttgatcgacgaaaatgagtacgatctgttcaagtttcaaacagaaaggaatgtcatgcgaagattttcatccttcgactcttctgctgactacccaattcagagatcacaatccacttcctgcttcggaatccgcagatgtttcctctgctaattccgctgcaaaatttggaaaataaaacgttgaaattttataaaatgtttttcatatattagtttattttgtgttccatcgtcttattattataatatttaatcagtttgtgtcggtaatgcaactccgaatcatataatacgtttacctttttgttaaa

SEQ ID NO: 38 - DNA, 1089 bp, Arabidopsis thaliana
atgtcttcttcttcttcaatggacttactcatgtgtctgcttcttctaatctctccggttgttctggccaagtcttcttccaccgtccctgctatctttaccttcggtgactctatttttgacgccggaaacaaccattacaacaaaaactgtaccgctcaggctgattttcctccttatggttcttcctttttccaccgtcctactgggaggttcaccaacggaagaaccgtcgctgacttcatctcggaatttgtaggccttccattacagaaaccattcttggaattgcagattcaaatcttgaatggaacttcaaacttttcaaatggcattaactttgctagtgctggtagtggtctcttgcttgataccaacaaatttatgggcgtgacaccgatccaaacccagctacagcaattccagacacttgtagagcaaaaccttatcgaaaaatctataatccaagagtctctcttcttattagaaactggttctaacgacatcttcaactacttcctcccattccgagctcctacactttctccagacgcttatgtgaacgcaatgttagaccaagtgaacaaaacgattgatcagatctacaaactaggcgcacgccgcatcgctttcttctccttaggtcctgtaggttgtgtccctgcaagagccatgcttcctaatgccccaaccaataaatgctttggtaagatgaatgttatggccaagatgtataataaaagacttgaagatatagtgaacataatccccactaagtaccctggagccattgcggtgtttggagctgtatatggtatcactcacagatttcaaacctaccctgcccgttacgggttttcggatgtttcaaacgcgtgttgtgggaacggtacactgggaggattgatgcagtgtggaagagaaggatacaagatttgcaataacccaaatgagtttctgttttgggatttttatcatcccacagaacacacttaccgtctcatgtcaaaagctttatggaatggaaacaaaaaccatatcagaccatttaatctcatggctcttgccaccaacaagatcacattttaa

SEQ ID NO: 39 - DNA, 444 bp, Arabidopsis thaliana
aaatcacattctcaaatacacattttaagaaagaaaaaaaaaaattgaaagttgagaaaagttcctagagtttgaagacatgaagttcacggcgcttgtgttcattgtgttcgtggtgggtgtcatggtttctccagtttcaatcagagcaactgaggtcaaactttctggaggagaagctgatgtaacgtgtgatgcagtacagcttagttcatgcgcaacaccaatgctcacaggagtaccaccgtctacagagtgttgcgggaaactgaaggagcaacagccgtgtttttgtacatatattaaagatccaagatatagtcaatatgttggttctgcaaatgctaagaaaacgttagcaacttgtggtgttccttatcctacttgttgatttttgagatattgctaaaaaaagttgttaatgataataatatttaacaaaca

SEQ ID NO: 40 - DNA, 1032 bp, Arabidopsis thaliana
aactgagagagatcagagaaagagagatttgtaataatcaaatcatggggaagagaagaggtgtctccgccgtgaacgttgttttcgggtggctgcgacaacaatcgaacaaggttaaaatagctttaggaattatcatctctttgatcctcgtcgttcttctgaaattcaccgttaggaatcacaatcactttttcatcgcctccgagctcatccacgccgccggaatcttgatcctcatctacaaactcactcgccaaaagacttgctccggtctttctttaaaatctcaagaagtgacagcaatatttctagcggtgagattgatatgcagcataaacatggaaggtgatatccatacagttctcgatttcgccaccttggtttcgactctatgggtcatttatatgattcgatacaagctgaaagcatcttatataaagtctctcgacacttgctacaattactatgtgcttgtaccatctgctatccttgcgttgattattaacccgagtacgagttattcttacttccaccgtatattgtgggcgttttgcgtctacacagaatctgtctctgttctacctcaacttcgattaatgcaaaatgctcagatcatagagcctttcacagctcattatgtgtttgcactcggaatagctagattcctggcatgcgctcattggattatccaggtcgttgagactcgtggacattacctatggctactcggggctggttacttctggtttccggtggctctactagccgagatcgttcaaactttcatcctcgccgacttttgctactactatgtcaaaagtgttatggagggtcagcttgtactgaagatgccggtttaagatcatctagtataaaatgaaccaataaattttgcttgttttatctttcaacttaaactacaacttttaaccaaagtagattgctcaaaataatctagaatggtttctttcttcttctctatttcctgctttttgtttaagaatctttagagaaagttaatcactatac

SEQ ID NO: 41 - DNA, 1437 bp, Arabidopsis thaliana
acaaaacaacgattcttttaaaataagaacctctctgtttctctctctctctatatatatctccctccccgctgatcgatggcggcttctgttgatcctttggtggtcggaagagtgatcggagatgtgttggacatgttcatcccaaccgccaatatgtctgtctactttggccccaaacacatcactaacggctgcgagatcaaaccctccaccgcagtcaatcctccaaaagtcaacatctcgggccattccgatgagctttacactctcgtgatgactgacccggacgcacctagcccaagcgagccgaacatgagagaatgggtccactggattgtcgtggatattcccggaggcacaaatccctcaagaggaaaagagatacttccatacatggaaccaaggccaccagtggggattcaccgttacatattggtacttttccggcaaaactcaccggtgggtctgatggtgcagcagcctccatcacgagccaatttcagcacacgaatgttcgctggacatttcgatcttggtctacctgtggccactgtctatttcaacgcccaaaaggaacctgcttcacgcagacgctagtacaaaaagtaaacaaataccatctacaaataagccaaaaatccggaactttttggtttgaaaaccgaaaggaacctttacctataaaaaaccaaagcggacaaaaaatgtggtattatatatcaaaccacattatctattagtccggttatagctaaatctatctatgtagctctatctatatggcttacaaatatgtgtatcttttttatgtctttttgatatggagttgtttgtaataatatatggtgttcgtctctatattctccaaataatcataaattaagagttataaagaagctaagaaaagattacataccaaaattaaagagattacaatcgctggaagaaatctaatatactgtgtttcttcttgattatagtcttgttgttctctgaacttttacagcttgttttcactttgaaattctcggttctaggttttgttccacgcactctctttgtcgtcatgttcacatgatcttgaacttcagctagatctacttctgttgtttcaaatgtttctttcactctgttcttctcactgtcctgtttgattccagcggcatcaagtttggacagatcgattgtaacacactctttttgatcctcgtgttcgtgagagtttggtgaagaagaagccacgtccactgctttgcttttggtcacaaacgaatcagcgagttcttgcacaccgtattctgcgatttccagattgatttcatcggtttttctaatcttgaacgggttgttgtccggaataagtgagggattgctgggtcgggtaaccacttgatccctgttaggctgcgcaagcagtttgtatagatctgaatc

SEQ ID NO: 42 - DNA, 2415 bp, Arabidopsis thaliana
tacacgtcccccacacatctgaatgcagattctgtgagatatataaagctacttaagattctaatcctatgattattgtaagaactaaaaaaagaataatcagtgcattttagagagaagatagagatagagattaccttcttcttcttcttcttttttgtcaaagagagagattaccttcttcataggaaaagatttctttcttcttctgcattccccaaattttatcttcccaagaaacccaacacagaagaaaatcttaaagtgaattgtggtggagatgaaagttggagctccggcaagtaagccgggtcggatcattgttcaagtttttcttctacaacttcttcttcttcttcaaagtgttcattcacagagatcacaaaacaaacttaacatcacaaagcctggacaaaacataccagccttaacagttcagctaaggagagttggccatgatacggtggtagttgataatggtattgtccaagttactttctcgaacccagaaggcttaataactgggataaaataccatggtatcgataatgtgttggacgacaaaattgatgatcgcgggtattgggacgtagtctggtatgaaccggaaaagaaacagaagactgacaaattagaaggaactaaatttgaaattataactcagaacgaagaacaaattgaaatttcatttacaagaacgtggactatctctagacgtggctccttggtccccctaaatgtagataaaagatatattattcgaagtggtgtgtccggattatacatgtacggtatattggagaggttagaaggttggcccgacgtggacatggaccaaatcaggattgtcttcaagctcaacccaaaaaaatttgatttcatggcgatatccgatgatcggcagagaagcatgccatcgatggcagatcgagaaaattctaagtcattagcttacaaagaagctgttcttttgacaaatccaagcaaccctatgttcaaaggagaggtggatgataagtatatgtactcaatggaagacaaagacaacaatgtgcatggttggatctcatcagacccacctgttgggttttggatgataactccgagcgatgagttccgtcttggtggccccatcaagcaagacctcacctctcatgccggacccatcacactctccatgtttacgagcacgcattatgcgggaaaagagatgagaatggattatagaaatggagagccatggaagaaagtttttggtcctgtcttggcttatctcaactctgtctctcccaaagattctactcttcgtctctggagagatgctaaacgacagatggctgcagaagtcaaaagctggccttatgattttataacttcagaagattatcctcttcgccatcaaagaggaactctcgaaggtcaattcttaatcaaagacagttacgtgtcaaggttaaagatatatggaaaatttgcttttgttggtttggccccaattggtgaagctggttcatggcaaaccgaatcaaagggttatcaattttggacgaaagctgacaggagagggagattcataatagagaatgtgagggcaggcaattatagtctctacgcatgggggtctggttttattggagactataagtatgagcaaaacattaccatcacgccaggtagcgagatgaatgtagggcctttagtgtatgaaccgccgagaaacggtccaacattgtgggaaatcggtgtaccggatcgaaccgcaggtgaattctatataccggatccttaccctacactgatgaataagctttatgtcaacccactccaagacagatttaggcaatatggattatgggatcgttacgcagatttataccctcaaaacgatcttgtctacacaatcggtgtaagtgattatagaagtgattggttctttgcacatgtggcgagaaacgttggtaacgatacataccaaccaacaacatggcaaatcatattcaacctaaaaaacgtgaaccgtatcggacgctacacactccgaatagctctagcatcagcagctgattcggaactacaaatccgaatcaacgatccgaaatccgatgcgattttcacaaccggttttatcggaaaggacaatgcgatcgcaagacatggaattcatggattatatagattgtatagtatcgacgttgctggaaatttactaagtgttggtgataatacaatatttttaactcaaaccagaagtagaacaccatttcaaggtattatgtatgactatattcgtcttgaaagtccttttagaacttgagaaaataaattggatagagttaaaaataatttcatgtagaagaaggtttaaatttatttatttgaatgtaatgtgaatgaatgtaataagactatatatat

SEQ ID NO: 43 - DNA, 2295 bp, Arabidopsis thaliana
atgattcgcggcggaagaaacaacattacttccgctccggcgttttcgaaagacgcaaagaagcttcttttatgcacagccaacaccgtctctgtttacagcgtcgccactggcttaaagattacttcactcgaggatcatacagcgcctgtgacgtctgtgattgttgatccgtcttccgacgaaaccgtcagttactgttggacttcgtcgctcgatgggaaaattcggatttgggagttctctgcgccgaagcttttgaagatatttgatacccaccttccaattcactctctggtgatgattccagctcaagtgtcacattccgtgattgcttatgtttcggttgaggactattcaagtgtgtccaaagatttgtttggacaaatccggagatatgatctcactcaagaccctcttcatagtggagacactttgaaagagatggaagaaccaaaacctattgttttaagtccctctggagagtttttcggcgtctgtcataactgcagtatacatatatggaatgtggcatcagagcacctcatgccaaaggagacgacattacatcatacagagttgattactgtttttgctttccatcccaatcagagaatattagcagccggtgatgtaacaggaagagtgttaatttggaaggataatggtattggagaatttacttcagtgaaaactgaagatgatactgaatcttgcactactttcaactggcacagcgctgaagtaaccgtccttaatttctcttcagatggagcacttttgtattctggggtaaaggcaggtgattttgttgtttgggagctaggtacagggaagaagcaacttttgccaaagattggatctcccttgttgtatttcatcttctcttcagattcaactctttcttctgtgatttgtgcagataatcaaattcatcttcttaaaatgccttccatggagatattgagaacgatatctggaatcaagcctccgacaccagagcgtcacgggtttatatgctacgtcaaaacgcgggatatatgcctcaccagaactgtatccattgatcgttcttccggtatagctgctttctgcacagcgaatcatcgtgttcaactctacaaccttttaagtgaccatgacatttcagaggttcaaatttgcgatcatcatccagacgatgatgatcaagtccgggttctcgtgactgcggttgctctctctcggaatggctcagtaatgactacagctgaggccagatttgctgcaagcaatttcagtgaaggcatagtttctctcaagttttgggtatttgtaccggacagcaaaactttcagcttatcgacagtcataaatcaacctcacagggaagctgcaattacagccattgcccttaaccccgcccgttccatggctgttagtatatcttctgctggggacttcaagatttgggtttgcagtagcgacaagaatctgacacctgaggactcaaactggatttgtcatggagttggctcttataagagaacgccaataacagctgctgttttttccggggatggttcttgtctggctcttgcggctaaaacagttattacgatctggcacccgttaaagaacgaactcctgtatgtagttggaaaggcaaatgcgccaattatggaactctcattcactggaggaggcttccttattgctgcatcccatggttccacaccgcacttatctgtctgggatctgatgacgttctgcttatcatggtcatatagattatacatagaagccattgctactgaagtggactcaccatactttgcagttttaacatggcttccagaatctgataggttggtaaaatctaacgaacagatattccgcgggaaagatggtgctatcctcttgtttgatgggtcaggccctaaaccagtagctatttggactgtaatgaaggccagaggaggaacactttcatttgtggaagatggtaaaaagtctcagccgcttctcgcgtatgtaaacaggagccatgaatatgttctatttgatccttatagcgatgaaaaactcgagactagcgccatagattatgaagtttttcttgcagcaataagcaaaaagaagaagagatctaggaagaaagcattgatgtcagagaaaccttgggaaacaatgttttgtggatcaacactcaatttcccgcctttccccgacttgtgcgcttcgttcttcagttcccggatgcagaaagaggtgtgtgagagagcagatagacaacctgaaagacatagctcttga

SEQ ID NO: 44 - DNA, 1628 bp, Arabidopsis thaliana
gttaacacctaggttcttgtttcctaacaaaggctctactttttctttagttaactactatggctcatttcctcgagacacaggagcccctcgtattctccgggaagaaacgaaacgatcgcgatgacgaagacggtgacgccttggttgcgaagaaatcagcactggcggtgtgtgatgccgaccctgcagcggccatagcgaatatccgacatgagtttggggagcacgggggagtaaacatgtccatcgaagcctccgccaccttcaccgtcatggaaccggataccatgaggcggatgttcaccggagaactgggaccggacaacgacttctacgtatacagccgacacttcaaccccaccgtgctcaacctcagccgccagatggctgctctcgaaggcacccaagctgcctactgtacctctagcggtatgtcggcgatatcgtcagtgatgctgcaactgtgcagcagcggaggacacgtggttgcggcaagcacgctatacggaggaacacacgctttgctctctcatttcttgccacggacatgtaacataaccacctccttcgttgacataacggaccatggcgccgtggcaaacgcgatcgttgagggtaggacacaggttctctactttgagtcggtggcaaacccgacgctgactgtggctgacatacctgagctgagccgtatggcacacgagaagggcgtgacggtggtggtggacaacacattcgcccccatggtgctgtctccggccaagcttggagcagatgtggtggttcacagtatctccaagttcatcagtggtggggctgacatcatcgcaggggccgtgtgtgggagtgagaatttggtgaaagagatgatggatcttcgtggcggatctctgatgcttctaggtcccaccatgaacgccaaggtggctttcgagctctccgagcgaatccctcacttgggcctacgcatgagagagcacagccacagagcccaagtgtatgcggagagaatgagggatttgggcatgaaagtcatatatccagggctcgagacccacccgcagcacaagctattcaaagggatggtgaatagagactatggatacggaggattgctgtcgatagacatggagacagaggagaaagccaacaagctcatggcatatctccagaacgccactcagtttggcttcatggccgtcagtttgggttactacgagacactcatgtcttgctccgggagcagcactagcagcgagcttgacccctcacagaaggaagctgcaggcatctctcctggtcttgtacgaatgtcggtggggtatgtgggtacattggagcagaagtggacacaattcgagaaagcattcctcagaatgtaaaatgtcttcttctatatatgatggttttctttcccccaaataccaacaattcatcatctgcgttatatgtatgatgtggccaatgttcagtctcttatttgttatatcacaatgttctagtcttcgggagtcttttcttgcatatgtaactaaaaaatatttgtgtttttggttagaaagtgaaatttacctataaaaaaaacagcaagggtatccgaaattggacgcacattgcaaaccact

SEQ ID NO: 45 - DNA, 1282 bp, Arabidopsis thaliana
ggaaaacaaaatctactctcataccaaaaaatgaatcatctatttagttgaagaaaagagagctttgacgaaaaaatcatcctttagaatggcaaagactgatgtggatgatgagtatggtcttaaaccctctgagttatatggaaaaaatacatggaagattaagaaattttcacaaatcagcaaaagggagttcgctagcagtgtttttgaaattggaggctacagttggcatattttaatgtatccagaaggatgtgatgttagcaatcatctctcattatttctctgtgttgcaaaccatgatgaacttcttccaggctggagtcagttggctcagtttactatatctgtgatgcataaagatccaaagaagtctaagttttcagatacgctgcaccggttttggaagaaagaacatgattggggatggaaaaagtttatggagttaccgaagttacgggatggcttcatagatgattctggctgtcttacaattgaaactaaagttcaggtgatcagagacagggtggaccgacctttcttccttgattatggttacaagacagaaattgttagggtgtattttcgaaatatagagcaaattttcctacgctttgtggaggagagaagaagcaagcttgagaagttgatagaggacaaggccaaatggacaagcttcggtgttttctggttaggaatggacaaaaactctaggcgtgagatgtctagagagaaaatggacgtaatcctaaaaggatttgtaaaacactttttcatggaaaatgttgttacatcacctatagcgatggattgcttgtataatgggttgaaggatcttgaagtccaaactaagaacaagaaagctagcccaaaactgttagatgacaaggaattgccagctccgtttgttaaagtggacagagatatgttcgtattagttgatgatgatgtgttgttactcctagagagggctgcactcctagagagggctgctccagagccattgcctccgaaagatgataaagctcttcaaaaccgtattaaggaggacaaggatgaagaagatatcaacaaggaagcttatgagatatgtttaaatgagtggggtagacgaactgtggagatatttgttcttgaccatatctttagcaaaattgaggttgcatacaaagaagctattgcgcttaaaaggcaggaagaacttatccgtgaagaagaggaaacttcaaaacggagcaaagtgctaaaaaagggttttgggaaatgtagactgaattag

SEQ ID NO: 46 - DNA, 1562 bp, Arabidopsis thaliana
cttactctttagaacttttcaaatcatataatattattttacgataaatttataatagaattgtgcatcttagggggaattacagaattcaataatctaattttatttgctctaatcgttagttttttttttgttcgtagttgaagaaaagagagctttgacgaaaaaatcatcctttagaatggcaaagactgatgtggatgatgagtatggtatgtgttttagcaatatgattttttttatgaatatcgtcaaaaacgtccccactatcccgtccacaaatgattaaggttttcgagatatgttaatagatactatacccgtttgtttgtttttgtgttttagtaatatacttctctttttcagctaatttaatgtgaaatttcttatttttctcaggtcttaaaccctctgagttatatggaaaaaatacatggaagattaagaaattttcacaaatcagcaaaagggagttcgctagcagtgtttttgaaattggaggctacagttggcatattttaatgtatccagaaggatgtgatgttagcaatcatctctcattatttctctgtgttgcaaaccatgatgaacttcttccaggctggagtcagttggctcagtttactatatctgtgatgcataaagatccaaagaagtctaagttttcagatacgctgcaccggttttggaagaaagaacatgattggggatggaaaaagtttatggagttaccgaagttacgggatggcttcatagatgattctggctgtcttacaattgaaactaaagttcaggtgatcagagacagggtggaccgacctttcttccttgattatggttacaagacagaaattgttagggtgtattttcgaaatatagagcaaattttcctacgctttgtggaggagagaagaagcaagcttgagaagttgatagaggacaaggccaaatggacaagcttcggtgttttctggttaggaatggacaaaaactctaggcgtgagatgtctagagagaaaatggacgtaatcctaaaaggatttgtaaaacactttttcatggaaaatgttgttacatcacctatagcgatggattgcttgtataatgggttgaaggatcttgaagtccaaactaagaacaagaaagctagcccaaaactgttagatgacaaggaattgccagctccgtttgttaaagtggacagagatatgttcgtattagttgatgatgatgtgttgttactcctagagagggctgcactcctagagagggctgctccagagccattgcctccgaaagatgataaagctcttcaaaaccgtattaaggaggacaaggatgaagaagatatcaacaaggaagcttatgagatatgtttaaatgagtggggtagacgaactgtggagatatttgttcttgaccatatctttagcaaaattgaggttgcatacaaagaagctattgcgcttaaaaggcaggaagaacttatccgtgaagaagaggaaacttcaaaacggagcaaagtgctaaaaaagggttttgggaaatgtagactgaattag

SEQ ID NO: 47 - DNA, 1129 bp, Arabidopsis thaliana
atcaaattcgatttcatcgtcgtcactcgtcaatcgccaaatcaacaaaatcgtcttcctcgttcgtatcgttcactcagcttttttcccatcttcttcttcgcatcacatattcttcattactaatatatctcctactccagtcttcctccatgaattcctgtagcttaggagctcctaaagttagaatttttgcaacaaatttcagtagattaagatgtggaaacttgctgataccgaacaatcaaagactatttgttgaccaaagccctatgaagtatctgagtctgagaacgactctgcgatctgtgaaagctatccaattgtctactgtcccacctgcagaaacagaagctattgcagacgtaaaagattctgacgagaccaaatcaactgttgtgaatactcacctcatgcccaagtcctccgaggtggaagcactcatcagcgaaatcaccgattcctcatccattgcagagtttgaactcaaactgggaggtttccgcctgtatgtagcaaggaaattaactgacgaaagtagtccaccacctcagcaaattcagcctgtggttgctgcaagcgcaactcctgagggggttcacactaatggctcagctacttcttcgtcattggctatcacaaaaacatcatcttcttcggcagacagaccacaaacactcgctaacaaagctgctgatcagggtttagtgattctccaatctccaacggtcggttatttcaggagatccaagaccataaaagggaaacgcactcctacaatctgtaaagagaaagacatagtgaaagaaggtcaagttctatgctacattgaacagctcggtggccaaatcccagttgagtctgatgtttccggagagattgtcaaaatactccgcgaagatggcgagcctgtaggatacaacgatgctctcatcacagtacttccctcatttcctggcatcaagaagcttcagtaagaactgattttggcttaattgtgtttgtgctttgtgtattttgcttcttagtttttctccacatagacaaaaataagctctactccaaaaaatctttgtccgtaccattacctttgttttaccaaaatttaattgaaacttttttgtttacc

SEQ ID NO: 48 - DNA, 851 bp, Arabidopsis thaliana
ctcattttccaccattaaaaaacctctctactctctcctcaaaaactcaaaagagcaaaaaaaagagaagaagaatcaaaatcccacacaatggcaacacactcttccttcaccgcaacaacacctctctttctcatcgttcttctatccctatcctccgtctcagttctcggcgcatctcaccaccacgcaacggcgccggctccgtctgtagactgttcgactctcatactcaacatggctgactgtttatccttcgtttcgagcggaggcacggtggcgaaaccggaaggtacatgttgctctggtcttaagacggtgcttaaagctgactctcagtgtctatgtgaagcgtttaagagcagtgcttctcttggagttactttgaatatcactaaggcttctactcttcccgccgcatgcaagcttcacgctccttctatcgctacttgtggattgtctgttgctccaagtactgctccaggtcttgctccaggagtagctgctgctggacctgagacagccggatttctagctccaaatccttcttcagggaacgatggatcttctttgattccgacctcgttcacaactgtactcagtgccgtactgttcgttttgttcttctctagtgcgtaaaaaaaaacctgaatcttttttcaccagctagatttggctgtatgaaattgattaatggtttttattagggttaatctatgtatgttttggagtgttctgtttttagaccatatcggtttctctattactagcgtttactcttttagtttatgttattactttgtctcacaacattggtccttttattcgatctatcgcttattccttcatct

SEQ ID NO: 49 - DNA, 839 bp, Arabidopsis thaliana
ctcattttccaccattaaaaaacctctctactctctcctcaaaaactcaaaagagcaaaaaaaagagaagaagaatcaaaatcccacacaatggcaacacactcttccttcaccgcaacaacacctctctttctcatcgttcttctatccctatcctccgtctcagttctcggcgcatctcaccaccacgcaacggcgccggctccgtctgtagactgttcgactctcatactcaacatggctgactgtttatccttcgtttcgagcggaggcacggtggcgaaaccggaaggtacatgttgctctggtcttaagacggtgcttaaagctgactctcagtgtctatgtgaagcgtttaagagcagtgcttctcttggagttactttgaatatcactaaggcttctactcttcccgccgcatgcaagcttcacgctccttctatcgctacttgtggattgtctgttgctccaagtactgctccaggagtagctgctgctggacctgagacagccggatttctagctccaaatccttcttcagggaacgatggatcttctttgattccgacctcgttcacaactgtactcagtgccgtactgttcgttttgttcttctctagtgcgtaaaaaaaaacctgaatcttttttcaccagctagatttggctgtatgaaattgattaatggtttttattagggttaatctatgtatgttttggagtgttctgtttttagaccatatcggtttctctattactagcgtttactcttttagtttatgttattactttgtctcacaacattggtccttttattcgatctatcgcttattccttcatct

SEQ ID NO: 50 - DNA, 898 bp, Arabidopsis thaliana
aaaaaaaaaaaagttttataaaggttctcaactcaagttctcttctctaaaaaacccaaacaatggcctctgcagacaaactcataaacacagatgtccctgaaaaggacgtttttgccttccacttcctccaatccctctcaaatctcagaaaacaaaacccttttgatactccggaccaaaaaaactaccgcgtgaggaagatcaagaaggctgcgtacgtttccatggccagagcagccggagggagtagccggctatggagcagagccctcttgcgtagagcagacaaagatgacaacaagatcgtaagattttcaaggaggaagtggaagatatcatcaaaacggaggaggagtaaccagagagctccggtggtggaggaggcggcggagaggctgaggaatcttgttccgggaggcggaggaatggagacgtcaaagctgatggaagagacggctcattacatcaagtgccttagtatgcaggtcaaggtcatgcagtgtctcgttgatggcttatctcccaaatgatcatcaattaatcatcaacatcatcatcaatgatcgatgtatatagagatacgacacatacatagtctattggattggggtaatcataacgaatatatatgtgtatatatatatatatatatatatatatattcttatatatatacatacgtgtaagataggatacatatatgaaatgtgtggatatgtattagtctcgaagtaacgaaagatttttttctttttcttttcttgaattttgataaaaggggatttattatttatcatatgctatggccggtttaaacattagggcttggtaacttgcccttgtcatatgataaaaggggatttattacttatcatatgctaagagaattttcttt

SEQ ID NO: 51 - DNA, 459 bp, Arabidopsis thaliana
aatttagtcaaaccaaaaaaaaaaaaaaaacgaaagcgcaaagactaaggagaaaagaaattcttcgcttcttctccggtgtaatcatgacaacctcaaaaagactagcagacaggaagattgagaaattcgacaagaacatattgaaaagaggatttgttcctgagaccaccaccaagaagggtaaggattaccctgttggtcccatcctcctcggcttctttgtctttgttgtcattggatcatctctcttccagatcatcaggaccgcaactagtggaggaatggcttaaacccaatcacattcaagctggaagattgcaattctcaaattgatgaatcatcactttcttctcttctgacttgtctctttttttcccttatactgtagaatgtgactactttctgttgactacatgttattgaaagaatttttgagtctttttctaatatccactc

SEQ ID NO: 52 - DNA, 715 bp, Arabidopsis thaliana
gagagagagagagagacgatggaggggaaagggaaagagatagtggttggacattccattagtaaatcaagtgtagagtgtcacaaatattacctggcacgtcgaaccaccatggagatgctccgagacagaggatacgatgtctccgacgaagatattaacctctccctccagcaatttcgagcgctctatggggaacatcctgacgtagatctacttcgtatctcagccaaacatcgctttgattcttcgaaaaagatctcggtagtgttttgtggaactggtatagttaaagtcaatgcgatgcgcgtcattgcagcagatgtgcttagccgagaaaatataaccggactgatactggttttgcaaagtcatataacgaaccaagctcttaaagccgttgaacttttctcctttaaggtcgagttattcgagattaccgatttgttggttaacgtaagcaaacatgtcttgaggccaaaacatcaggttctgaacgataaagagaaggaatcacttctcaagaagttcagtattgaggagaaacaacttcctcggttatcgagcaaagacccgattgtgcgatactatggactagagacagggcaagtcatgaaggtcacatacaaagacgagctcagtgagtcgcatgttacataccgatgcgtttcttaaactcgttttgtttatattttcagctctttctttgtgtagc

SEQ ID NO: 53 - DNA, 2137 bp, Arabidopsis thaliana
ccgagacgttttggccttcttctcttccgaaatctgatacagtaacagaaacgaacctaatgccgcctcgccggagttaccccttcagtggtcacggaggtacaattgcacgattcattgaatttggggaagcatttggacactatggagaagaagaagacgaagaagaggaagacgaagaggaagcatatgtcgactatggtgaagtacaagaggaagacgaggaggaagaggaggaagaagattccgaacgccaaaccagggaatacatcgatgtcctagactcacctgttagggtttcacagaacgagagtgaagggatagagaatcagaataggtcacaaggtgtttgttcatcgtcttccggatcgcaggaggatgtcgaatggaaacaaggtgacactgagggattgtcttgttctatctgtatggaagtttggaccagcggtggccaacaccaagtctgttgtcttccctgtggacacttgtatggatattcctgcatcaacaagtggtttcagcagcgacgaagtggagggaagtgtcccctgtgcaacaaaatatgtagcttgagagatgtccggaaaatctatgcatcacgggttgctgcagtagatgatgaagcacacaagagaatcttatttctggaggccaagttaaggtcaattgaacagaagactgcgagttggagtaacaaagaagttcaatggaaaataactgaagctgagctacgattagaagttactaagctgaagaagaaaatagctaatatggaaagtacgactaagggttcgcaaagccagtctaatgtggcttctcaggagaaatatatacctgctcataatatctaccaagagcatcatggacagtcaccttcttgcagcttcagacatcagggagatctgctaataaacggtggccgtatatttgacatagatggtggtagacaaatattattatatgcccgtaggctctcaggcgttggtggaacgtttgtgcttacgcaaatgagcctacattcgccttgtgagattgatgatattttgttgcctcgtaccactagagcaattaaagatcttcacctttcccctcacaataatgggcttgcagtatttgggtctctaggaaaaaaattatctgttataagcttggagagccacaatactgtcttatcttatgatctaccggctgcaccttggtcttgctcgtgggatctcaaaagctctcaccatatttatgctggactacaaaatggaatggttttgatatttgacatgcgtcaaaccacgggacctttcgcatcgatgacaggcttaacaaccaatccagttcatactgtccatcatctctctggcaattccactccaacttctgatgtccgtaccctcttatctgcttcttccatcgggctgtgtcagtggaacattagtggtagcgagggaagcccatcattagtttcggaaacgggaaacccaggtgtatgcatatcctcctcgtactgtccccgcagcaatcatatagtagcttcttatagaccaagagttggatcatctgatgatacagtcccgactcagccctcattgactcaaacaggagtcagtaatagtaatagtaatggtgtagatggatttcatgtttgtcacaagagaagaggtgttgattcgtattaccagaaactatcctccacacaagctattgtagatcccatccgtttgccaagaacagcgattatagactttggtggggaaaggaaacaactttttgcatcttgtgacgagtccactcgggagctcatcttgcaagatccttcgacttttactatttctcaacggttgccattgtcaagtcatcttccgcttcaagatgtgaaatactgtcacgtcaatggttcggatctgctcggtctcttaacggatgatagattgcagattcttaggaacgaatctccatgaagattaaaaaagattgatagtcttgcaaggatggtgtttgttgaagagaaaacatgtatgtaaagcggctaactagtctatctatcttttgtaatctggagatgctatagagtagcgagccattacttaaatattattatcttagttatgaacctattgctgcaatgcagcctgctccttttttg

SEQ ID NO: 54 - DNA, 1438 bp, Arabidopsis thaliana
gagaggtttagcggtcgttttacattcttccaaagctctctcttttacagcttttcacaaacaaatcccaaatctgattctttcagctaaaattcttccatcaatcaatcgaattgtcaaaaaaaagatatcacaacccttcgtgtgttctcatttcttaatcttatacacttgaaatctccaaaaaggggaaaaagaaaatgagttggtgaagtttgagaaccatagagatgacgattcgatcgttgcgtaaaccaccgccggttaaacttgtgtttcctactctgattatactcttcttgacatgtttgttatgtatcttaacaaatttccaaaccatatcgtatcttttccgtccgctttgggataaaccgccaccgccttttaaacggataccgcattactatgcggagaatgtttccatgggacatctttgtgagcttcacggctggacaccgcggttagaaccgaggcgagtgtttgatgccatcattttcagtaatgagcttgatcttcttgaagtcagatggcgggaattggagccttatgtgtcgaagtttgtgatattggagtcaaacactacgtttaccgggatcccgaagccgcttttcttcgattccaataaggagagatttgcgtttgcggaggggaagattgtacatggagtgtttcctgggaagaaacggtctacggggcagccgtatgaggatccgtttttgcttgaggggcaacagcgagttgcgatgaactggttgcttagagaagctggtgtatcggatggagatgcggtgataatgtcagatgcagacgagattccgagtcctcatactgtgaagtttctacagtggtgtgatgggataccagatgtaatgcatttggagatgagggaatacatgtactcctttgagtttccggttgattacagtagctggagagcctctgttcatatatatagtaggaagtggactcaataccggcactcacgacaaacggacttgatattatccgacgcagggtggcattgcagcttctgtttcagacgactcaacgagtttgttttcaagatgaaaggttatagtcatgcagatagagtcaaacgcaaggagtttttggattatcagaggatacaaaaacatatttgcaaaggttatgatctctttgacatgcttcctgaaaaatacagcttccaagagttgattagcaaaatcggacccatcccgccttctgcgtctgcggtacatctaccagcctttttgattcagaacgctgctcgctttcggtttctcctcccgggaggttgtctccgagaaccctagctgaagattaagtacaaaatagagaagcaatagtttcttgttacaaaggtttttggcgtcacaccaacttaacctgaaacaacagataaataaagaaatagatcttataacatgttctgttt

SEQ ID NO: 55 - DNA, 1615 bp, Arabidopsis thaliana
cgagaaccagtttttttgttgatcctatcaacaatgacgaaaatagagcttcgagctttggggaacacagggcttaaggttagcgccgttggttttggtgcctctccgctcggaagtgtcttcggtccagtcgccgaagatgatgccgtcgccaccgtgcgcgaggctttccgtctcggtatcaacttcttcgacacctccccgtattatggaggaacactgtctgagaaaatgcttggtaagggactaaaggctttgcaagtccctagaagtgactacattgtggctactaagtgtggtagatataaagaaggttttgatttcagtgctgagagagtaagaaagagtattgacgagagcttggagaggcttcagcttgattatgttgacatacttcattgccatgacattgagttcgggtctcttgatcagattgtgagtgaaacaattcctgctcttcagaaactgaaacaagaggggaagacccggttcattggtatcactggtcttccgttagatattttcacttatgttcttgatcgagtgcctccagggactgtcgatgtgatattgtcatactgtcattacggcgttaatgattcgacgttgctggatttactaccttacttgaagagcaaaggtgtgggtgtgataagtgcttctccattagcaatgggcctccttacagaacaaggtcctcctgaatggcaccctgcttcccctgagctcaagtctgcaagcaaagccgcagttgctcactgcaaatcaaagggcaagaagatcacaaagttagctctgcaatacagtttagcaaacaaggagatttcgtcggtgttggttgggatgagctctgtctcacaggtagaagaaaatgttgcagcagttacagagcttgaaagtctggggatggatcaagaaactctgtctgaggttgaagctattctcgagcctgtaaagaatctgacatggccaagtggaatccatcagaactaaaagaagctctttgtgtttctggtaaactcttgtcttgcttcttgtaatgcttatgcattcgttgttgtgtcattgtgttaataagagtgtaagtttggttggtatgattaataaagtttcttagatatcaaaatcagtcggaacatctttgatcgaattgattattagataaattacagcggagggtgagacttgggaagaaattacaatatgtccatttaaaaaacacaagaaaaagactaggaaaaatctccaaatctccatcacaagcaactaagttcaatagcttcttggaacctcttgtcatacgtagcgggattgccaaatagccaaagactaaacttcgaacgagcagaactttccgatgagtttctcgccggaaaaaggcatttaactatggaggctgacggttccggtgtggctgtagtctgcagagtattgtttgttgttatctgctgagttagaggaagagggagcatgaacatcgcagctgatgaggccattgataagttgattcgaagaaattgggtgcaaattggagagattgcatttagatgtatatattatgagtggagaggatagagaatgaagggagtaggtgtgcgtatttttctttgggacc

SEQ ID NO: 56 - DNA, 2638 bp, Arabidopsis thaliana
gtaattaaggaatttaattagtaaatttttgaattcgtaattaacaaaaaaaaaaaaattaggaaaagaataaattttgtacggcgataattacacggtttcgccgccgagaggaggaagaaaaattcgttttctgatgatggaagagacgacggataacaccggaacaatcagctcgcagaagaacgttgctgcttctggtcacaatcatcaccaccgttacaaatatatctcaaattacggcgtcgggaggcgttttctgttcttcgcttcctgttttggattttacgctttcgtggctgcgacgtacgcgtggttcgtgtttccgccgcatatcggtcgtacggatcatgtatcgtcgtcttccttaggttgcagagaggacaatgaaggttcatggtccattggtgttttctatggagattctcccttctctctcaaaccaatcgaaaccagaaatgtatggagaaacgagagtggagcatggcctgtgactaatccagtaataacatgtgcctccttcaccaattctggtcttccaagcaactttctagctgatccttttctttatgtacagggtgatactctttacctcttcttcgaaactaaaagccccattacaatgcaaggggatataggagctgctaaaagtattgataaaggagctacttgggaacctcttggtatagctttggatgaagcttggcacttgtcttttccattcgtcttcaattacaacggagaaatatacatgatgcccgagagtaatgagattggacagcttaatctctaccgtgctgttaactttccattaagttggaagctggagaaagttatcttgaaaaagcctcttgttgattcgaccatagtccatcatgaaggaatctattggctaatcggatcagatcatactggttttggggcgaagaaaaatggacaactagaaatttggtatagtagctctcctttagggacatggaagccacacaagaagaatcctatctacaatggtaaaagaagtattggagcaagaaacggaggcagagcgtttctatatgacgggagtctttatcgtgttggtcaagattgtggtgaaaattacggcaaaaggatacgtgtttctaagattgaggttctttccaaggaagagtacagagaagttgaagtccctttctctttggaagcgtcgcgtaaaggtaaaaattcttggaacggggttaggcagcatcattttgatgtgaaacagctaagttctggtgaattcattggtcttgttgatggtgaccgtgtaacttcaggcgatctgtttcatcgggttattcttggttatgcctcacttgcagctgctatttccgttgttatcttacttggctttttgcttggggttgtgaactgcattgttccatcaacctggtgtatgaactactatgcggggaaaagaaccgatgcgctcctgaatctcgaaactgcgggtttgttctcagaaaagttaagacggattggttctcgcttgaaccgagtaccgccttttctcagaggattcgtgaagcctaattcctccatggggaaatttacgctcggtgttatagtcattttaggacttttgctcacatgtgtaggcgtgagatacatctacggtggaagcggagccgttgagccttatccattcaaaggtcacttgtctcagtttacgttagcaactatgacttatgatgctcgtctctggaatctgaaaatgtacgtaaagcgttactctcgttgtccatccgttaaagagatagttgtcatatggaacaaaggaccgcctcctgacctgtccgagctagactccgcggtgccagtcagaatcagagtccagaaacagaattctctgaacaacagattcgagatcgatccgctgattaaaacccgagccgttcttgagcttgacgacgatataatgatgccttgtgatgacattgaaaaagggtttagagtttggcgggagcatccagagagactggtcggattctacccgcgttttgttgatcaaaccatgacttatagcgcagagaagtttgcaagaagtcataaaggatacaatatgattctcacgggtgcagcgtttatggacgttcgctttgcctttgatatgtatcaatcagataaagcgaaacttggtcgggtatttgtggacgagcagtttaattgcgaagacattttactgaatttcctgtacgcgaatgctagtggatcaggaaaggctgtggagtatgtgagaccgtctttggttacaattgacacttcgaaattttccggtgtagcgattagtggaaacacgaaccaacattacagaaagagaagtaagtgtctccggcgattctcggatttgtatggaagtttggttgatcgaagatgggaatttggtgggagaaaagacgggtgggatttgtagatcagtagagttacttgtagggcaagtaagtagttcttcaaaaaaaacaaaaattaagccacagctctttcttgatatattttttgttgtaggttcaaaatgtaactttagcttcttcttcttcttcttcttcttttttttttaatttctctttcgtattgttagatattttagaaaatggtgaatggacaacgatttctgatt

SEQ ID NO: 57 - DNA, 2391 bp, Arabidopsis thaliana
gttcaaagcttttgttttgttcccaattctgaagttttgaatcaacaaatcttcaataaagttttctcctttcactatctttccatattcttcttcttagtaaaactttgcattaatggcttacccaaatttgtaagctctttgtttcctcccttcttcttattctcttcttcattctccaaatttgtttctaggtttcttcagtttgagcaatgaagaagtctaaactcgataattcttcttcacagattcgattcgggcttgttcagttcttattagttgttctgcttttttacttcctctgcatgagcttcgagatcccattcatcttcagaaccgggtctgggtccgggtctgatgatgtttcatcttcttcttttgctgacgcattaccgagaccaatggttgttggtggtggtagtagggaagctaattgggttgtcggagaagaagaagaagcagacccacatcgacatttcaaggatccgggtcgggtacagcttcggttaccggagcggaaaatgagggaatttaagtccgtctctgagattttcgtcaacgagagcttcttcgacaatggcggattcagcgatgaattctcaatctttcacaaaacagcgaagcatgcgatttcaatgggtcgaaaaatgtgggacggactcgattcgggtttaatcaaacccgataaagctccggttaagacccggattgagaaatgtccggatatggtttcggtttctgagtcggagtttgtgaaccggagtcggatcttggttttgccgtgtgggttaacgttaggatctcacattaccgtcgtggctacgccgcattgggctcacgttgagaaagatggtgataagacggcgatggtgagtcagttcatgatggagttacaaggattaaaggcggtggatggtgaagatccgcctcggatacttcattttaacccgaggattaaaggtgattggagtggaagaccagtgattgagcaaaacacttgttatcgaatgcaatggggctcaggtttacgttgtgatggtcgtgaatctagtgatgatgaagaatatgttgatggagaggtgaaatgtgagaggtggaagagagatgatgatgatggtggtaataatggtgatgattttgatgaatcaaagaagacatggtggttgaataggttgatgggtcggaggaagaagatgataacacatgattgggattatccttttgctgaagggaagctttttgttcttacacttcgagctgggatggaaggttatcatattagtgtgaatggaagacatatcacatcttttccttatagaacggggtttgttttggaggatgccactggattagcagtcaaaggaaacattgatgtgcattctgtatatgctgcctcgttaccttctacaaatcctagttttgcaccgcagaagcatctcgagatgcaaaggatatggaaagctccttcgttacctcagaagcctgtagagttgttcattggaattctttctgctggtaatcattttgcagagagaatggcagtgaggaagtcatggatgcagcagaagctggtcagatcatcgaaagttgttgcccggttctttgtggcattgcatgcaagaaaggaagtcaatgtggatttaaagaaagaagctgagtactttggtgatattgtcatagtaccgtacatggatcattatgaccttgttgtgctcaagacagttgccatctgcgaatatggggtgaacacagtggcggcaaagtacgttatgaaatgtgacgatgatacatttgtgcgtgtggatgctgtgatccaggaagcagaaaaggttaagggaagagagagcctttatattggaaacattaattttaaccataagccattgcgtaccgggaaatgggctgtgacattcgaggaatggccagaagagtattatcctccatatgcaaatggtccgggttacatcttgtcatatgatgtagctaagttcattgtcgatgattttgaacaaaagcgattaagattattcaagatggaagatgtgagcatgggaatgtgggtggagaagttcaacgagactagaccagtggcagtggttcacagcctcaagttctgtcagtttggttgcatagaagactacttcaccgctcattatcagtcgcctcgccagatgatttgcatgtgggataagctgcagagactcgggaagccccaatgctgcaacatgagatgacataacattgttttttgacggatttttcgttagaaaggaaaatgaagaagcagatgggtgataatggagctaactgttttagatctctgtatattatagaaacaatatataatgtatctatatatatatatatataatataatgaagggttcttgag

SEQ ID NO: 58 - DNA, 1808 bp, Arabidopsis thaliana
atctcttatccgaatcctcccaatttgtctgtctctcttttgttttctctgctaacagatctctctaaatatctgttacttttgttcatatctttttacttttcaaactactaattttcctttcgcttcttctattaataacaacactctctctctcagacttcttttcttttttttctacggcgttgattcattcgcaatgacctcagtttctgtgtaccataattgacctagcagattctgtttttaatggtagattctgacccggtggaatttccgccggagaaccgccgtggacagctcttcggcaaatacgaggtcggaaaattggtgggatgcggcgccttcgcgaaagtgtaccacgggaggagcacagcgacgggtcagagcgttgcgatcaaagtggtgagcaagcaacggctgcagaaaggaggactcaatggcaacattcagagagagatcgctatcatgcaccgtctgcgccacccttctatcgtgcgcctgttcgaggtcctcgccaccaaatccaagatcttcttcgtcatggaattcgccaagggcggtgagctattcgccaaagtctccaagggcaggttctgcgaggatcttagccgtcgttatttccagcagctcatctccgccgtcggatattgccactcccgcggcatctttcaccgtgatctcaaaccggagaatctcctcctcgacgagaagctcgatttgaagatctctgatttcggactcagcgctcttaccgatcagatccgacccgacggcctcctccacacactctgtggtacgccggcgtacgtggcgcctgaggttttggcgaagaaagggtacgacggtgctaaaatcgacatatggtcatgtggaatcatactgttcgtcctcaacgccggttatctccctttcaacgaccataatctcatggttatgtaccggaaaatctacaagggagaatttcgcattcccaagtggacctcaccggatctccggcgactgctgactcggcttttagacacgaatccgcagacgaggatcactatcgaagagatcatccacgatccatggttcaaacagggctacgacgatcggatgtctaaattccatctagaggactccgatatgaaactcccggcggacgagaccgacagcgagatgggagcaaggaggatgaacgcattcgacatcatctcaggatctccagggttcaatctctccggtcttttcggagacgccagaaagtacgaccgagtggaacggttcgtgtcggcgtggacggcggagagggtggtggagaggctggaggagatcgtgtcggcggagaatctgacggtggcgaagaaggaaacatgggggatgaagatcgaggggcaaaaaggtaacttcgcaatggtggttgagataaaccagctaacggacgagctggttatgatagaggtgaggaagagacaaagagccgctgcatctggacgagatttatggacagatacactcaggcctttcttcgtcgagcttgtgcacgaatcagaccaaacggacccagaaccaactcaagtacatacgacgtcgtagtttaggtatctgtcaaataaattatccaaataataattaaaaaaaaatatcccgggttatatgtaattgcttttttttttacccggagaatatctctgacataattattcaggaaatttctcgacaaatcttaatttttagttggcaagtatgtatcttcttgttatgtaatcataattatattttatataaatgaaaaataaaatataaaaaaatgtattacttgtttt

SEQ ID NO: 59 - DNA, 3252 bp, Arabidopsis thaliana
atgaggtttgctgcaacggtctccgagaagcaatctgagcaaagcgtggaagtaactgaggagtttgctgtgacaatgacagaaaaaagatcttgtgtccattttgataaatatgttgatttggataagttgttgaaaattatcaaatcttatcaacaaatcaagtgtggagaatgcaatgaaagagttcacgtgaagagaggaagtagatggggtgctagtaacaggagagactggtattcttcctctgaccagaattgtgctagaaatgctatttggctttgtttggaatgtggctattatgtttgtggagatgttggtttgccgactgaggctcagagtcatgttatggggcataacaggttgacgcgtcaccgtttggtgattcaatgtaaaaatcctcagttaaggtggtgtttctcatgccaatcacttctcccttttgataatgaagagaatggtgagaaaaaagatttgttgctggaagttgtgaaattgattagagaaagatctccaaacacgtactctgcttcatttgaaactgaattttcatgttcaggaagtatctatggtggtatagaagcaagagatggttatgctgtaagaggtttagttaaccttgggaacacatgtttctttaattctgtaatgcagaaccttctctctttggatcaattacgtgagcacttcttgaaagaggatctatctgttagcgggcctctcgtttcttccctgaaggaactatttgctgaatcaaattcagaggcaagcgtttttaggaatgagataaatccaagagaccttttcttttctgtctgttctcaggctccccaatttaggggatatcagcagcatgacagtcatgagttgctaagatgtttgttggatggtttgagcattgaagaatcgagcctgaggaagaagcttggtgtttctgatagtaatgacagttctacatatcagaaacctactctcatagattctgtatttggaggtgaaatatcgagcactgtttcttgtttagaatgcggacatttctcaaaagtgtatgaaccctttatggatctctctttacccgttccgtccatgaaacttcctcctaaaaagcaacaaatcctttctcaggcaaaggaggtccttaagaatggggcagtcagcaaagattcagaagttgtgtccgctaaacctgcatcggatcacaattccacagttccactctttccatcggatcacaagattcaaagcagaccagaaacctctgacaatgaaaccgatttggttttgctaagcgatgttagtgatactgccccatcaaccgaggctaaaggagttaatcagattttggtaggtagcacagaaacgctgatgcatgataatgatcgaactggaaaaactgtaccagataaagaagatgtacgagctacgcagtctaatgaagaaacatctgcaagtgggatttcagcagtgatagatgaggctcaagtttgcggttgtcctgatttagagcaaagttcttcatctgcaaatcagggggctgatgaagagcttgccttgatggttgcagattctcaggttctgtatatgccttataaagatcacttattctatgatgattatatggttgcagaagcttcctcgtcattcgtgagcggtgaccatgaaccaaaaaaagactattttgactttagcagttttcttgatgagcctgagatacgcgaaggacctgtttttagaccactatctaaatctgaagtttatgaagctggttttaaggctgactgcagtgatgataaaacagttagtgcaggtaagggtgaagcttcctcgtcattcataagtagtgaccatgaacaaaacatagattatgttgactttagcagtttttttgacgagcctgagatatccgaaagacctttctttcgaccgctatctaaatctgaagtttctgaagctggttttaaggctgactgcagtgatgataaaacagttagtgcaggtaagggtgaagcttcctcgtcattcgtaagcagtgaccatgaacaaaacatagattatgttgactttagcagtttttttgatgagcctgagatatccgaaagacctttctttcgaccgctatctaaatctgaagtttctgaagcaggttttatggctgtcagcggtaatgataaaacagttagggcaggtaagggtgaaactttttcttcattcatgagcggtgacaatgaacgaaacatagattatgttgagtttactaacagaatattcgatgatcgtgggacatctgaaagacctgtttttggaccaccatctaaagctaaagtttctgaagctggttttgtggctgtaagcagcgactctgatcctgcagttcttgatgaatcggattcaccagtgtctgtagataggtgtttggctcagttcacgaagcatgagattttgtcagaagacaatgcttggcattgtgagaattgttcgaagaacctaaaacttcagcggttgagagaaaagagaagaactaaagaaggattgagcaacagatgggtgaatgaaaatggagctagttcggcttttgatgagtgtagagacagttcactaaatcaatcctgtatagatctcgaaaacggttacaaagctgctcctccgatcacaaaattgccaaactgcaaggaagaggaaagcgcaatagatgatggatttgtgggagaggaaaatacaaagcaagctccaattacttctgttactgaaacacctctcctcggtggagaaaccatcagttctcaaccagccagtgacaatgaatgtgaaaattgggaagacttggcagtagattctgaagaagtgatagtaaaaagagatgctaggaaaaaggtacttataaacaaggcaccacctgtcttgaccatacatctcaaaaggttcagccaagatgctcgaggcagggtaagcaagctaagtggccatgttgatttccaagagttcatcgatcttagcaaatacatggacactaggtgctccgaagaagacgagccggtttacaggttggccgggttagtggaacatttaggggcaatgagtcgaggtcattatgtttcttacattagaggaggccacaaggagaggagagactctgatactaaagaaccaaactcatccatatggtatcacgcaagcgattctcaggttcgaccggcttctttggaagaagttctccgttctgaagcctatatcttattttacgaacgaatctga

SEQ ID NO: 60 - DNA, 1312 bp, Arabidopsis thaliana
ttcagtgccgtaaattttgttttcctcttcattttctgcatacgaaaagttcttttgggtatttgtgatttgtcatctccgaaacgtttctctctttaaaactttttttgaccgttctttataatttgaattgaaagagaagatgggaagagctgcgagatggttcaagggtatttttggtatgaagaagagcaaagagaaagagaactgtgtttccggcgacgttggaggtgaagccggtggttctaacattcaccggaaagttctccaagctgactccgtctggctcagaacttaccttgcggaaacagacaaagaacagaacaaacacgcgattgcggttgctgctgctacagccgcggctgctgacgcagcggttgcagcggctcaagctgctgtggcggtggtcaggttaacaagtaacggaagaagcggaggatattccgggaacgcaatggagcggtgggccgcagtgaaaattcaatcagtcttcaagggctatttggcgagaaaagcgttacgagctttgaaaggtttagtgaagctacaagctttggtaagaggatacttagtccgcaaacgcgccgccgaaacgctgcatagcatgcaagctctcattagagctcaaaccagcgtccgatcgcaacgcatcaaccgcaacaacatgtttcatcctcgacactcacttgagaggttggatgattcaagaagtgaaatccatagcaagagaatatcaatctctgtagagaaacagagtaatcacaacaacaatgcgtacgatgagaccagtcccaagattgtggagattgatacttacaagacgaaatcaagatcaaagagaatgaatgtggctgtatccgaatgtggagatgatttcatctatcaagccaaagatttcgaatggagttttccgggagagaaatgcaagtttcctacggctcaaaacacgccgagattctcttcatcaatggctaataataactattactacacgcccccatcgccggcgaaaagtgtttgcagagacgcttgttttaggccaagttatcctggtttgatgacacctagctatatggctaatacgcagtcgtttaaagccaaggtacgttcgcatagtgcaccgagacaacgtcctgatagaaaaagattgtcacttgatgagattatggcggctagaagtagcgttagtggtgtgaggatggtgcaaccacaaccacaaccgcaaacgcaaacgcagcaacagaaacgctctccttgttcgtatgatcatcagtttcgtcagaacgagactgattttagattctataattag

SEQ ID NO: 61 - DNA, 2450 bp, Arabidopsis thaliana
ttttttgaatcattcatgatttcttagctctctcaaaaaaatggcgtacaaatccctaaattcaatcaccaaatctgatatcgaagctctaggaatctccggtgatgtctccgagaagcttctcagagatctcgaagacattattcacggttcatccacgccgccggagacgtggattcagatttctcggcggatccttcaccctaatctccctttctcttttcaccagatgatgtattacggttgctacaaggatttcggacccgacctacccgcttggatacccgacccgaaggttgcttctttaactaacgtaggcaagttattagaaaagcgaggcaaagagtttttaggtggaaattacaagaatccagtttcgagtttctccagttttcaagagttctctgtatcaaatcctgaggtgtattggaaaactgtattggatgagttaaacatattgttctctgtacctcctaagtgtatattagagaaggatacttctggagataatcctggaggtaaatggcttcctggagcttacttgaatcctgcaagaaattgtttgactaatggtttcaagagaagattggatgatattgtgattcgatggcgtgatgaaggaagcgatgatcttcctgtgaataccatgacacttttggagttaagatcgcaggtctggttagctgcacatgctcttagtgctttgggtttggaggaagagtcagcaatcgcggttgatatgccaatgaatgttgagtctgtgatcatataccttgctattgttttagctggccacgtagttgtttcaatagctgatagtttctctccccgtgaaatatcaacacggcttaaaatatcaaaagcaaaagccatttttactcaggatgtgattattcgtggtgataaaagtattcctctctatagaagagtcgttgatgcagaagcacctctggcaattgttgtcccagctagaggctctagctgcagaatgaagctgcgcgagaaggatttgtcttggaacaactttttgggaaacgcaagaaatttgagaggcgtggaatatgttgctgcagagaaaccagcaggagcttacacgaacatccttttctcatcaggaaccactggtgagccaaaggctattccatggacgaacatttctcctctgaaatctgctgctgatgcttggtgccatttggatgttcagcggggggatgttgttgcttggccgaccaaccttgggtggatgatgggaccgtggcttgtttatgcttccttgatcaatggggcttgcatgggattatacaatggatcacctcttggtcctacctttgccaagtttgtgcaggatgccgaggtatcagtgctaggcgtgataccaagcattgtccggacatggcaaaactcaaactccacttcaggctatgattggtcacggatccgttgttttggttccactggtgaagcttcaaacatagacgagtatctatggttaatgggcagagcacattacaaacccgtaatcgagtattgtggcggaactgagattggaggcagttttatctcaggttctttgcttcaacctcagtcgctggctgcttttagcacagctgccatgggttgcaagcttttcattctcgatgaagatagcaatcctattcctccatatgctgcaggagtaggcgaattggctctttgtcctcacatgtttggagcttcaagcactcttctgaacggtaatcacttcaaagtttacttccaaggaatgcccaccttccaaggacagatcttacgaagacatggggatttatttgaacggacttcaaaaggatactaccgtgctcatggacgtgctgatgacacaatgaatcttggtggtataaaggtcggttctattgagatcgaacgagtctgtaattccgttgatgacagtgttctggagacagcagccattggtgttccacctcctagtgggggtcctgagcagctagtaatcgctgttgtgttcaagagcccagaattttcaaatcccgacttgaacctgttgaagaagtccttcaactccgagatacaaaagaaactgaatcctttgttcaaggtatcatctgttgtgactcttccttctctaccgaggacggccacaaataaggttatgagaagagttctaaggcaacagcttactcagactggtctaaactcgaagctatgaggcaatttctctctaataccaaatgttgggttttgccattcacaggaaacaatatttggtctttgttgtaagaatccacatccatgtctgtatcaagaaatgattctcaattcacataaataagagtggagctagtgtacatacatctagtgagatccttgtccctcaatttgaatctcaactttggttatgattttatttcgtaacaaaaaccatattaaataaaacttgctatccaaaacgc

SEQ ID NO: 62 - DNA, 2132 bp, Arabidopsis thaliana
ttcttcttcttctccaaatggattcaacatttagagatgaagatctcgttgaagagagagaagaactcatggtgtcttacagtgagaataacagtcgacctatcatgaaaaaagctcactttttaaaaccctttgtcacctcctccattgatgggtttcaaggtatgcttcgtccatctccttctcctgagttaaaagcttcgtctttaagtgtttcctttcgtgggtggaggttaccaaacaaaaagtttcagttttgggttaaaaaaatggtagctttacacaaacccacttggttaaaatctgggatttttgaagcaatcaaagcatcgacttacagaatccacaaaaatccgtctttgattctctctctcgctcagaattggtgtcctgaaactaatacatttgtgttcccttggggtgaagctaccataactcttgaggatgtgaatgtgcttctgggtttttctatctctggttcttctgtttttgcttctcttcaaagctcagagatgaaagaagcagtggagaaacttcagaaacgatgtcaagggagcatgaagcaggaatcatggatttcaagctttgtagatgatgaaatggagcatgaagcgtttctagtgttgtggctttcgaaatttgtgtttccagacaagttttgcagttcgatttccagtgatgttttccccttagctgttcgtctagctagaggtgaaaggattgcttttgctcctgcggttctagcaaacctatacaatgatttgggtcatatctgtgttttagcctctatacaaaatgttttagctagttctctgtttaagcttgtccaagtatggatttgggagaggttcaagagtataagaccagaagctaaggtgataccaaggggtcaacctagaattgctcaatggagtggtctgaaacagagatttaagaatgtgggactgattatttttcatggtaattttgattggcgtccttatagtgaacctttggagaattggaacccacctcggttttatgttgaagaagctaagtgggtgaggattgatgagagtcttgatggtgattatgatgacgatgatgagtttgtgtcgtttgctagatgtgtgagagtttctaagcttgtaggtattggtgtagtagagaactactatccaaaccgagtggcgatgcaattcggattggcgcaagatgttcctgttttgggtactaatcatagaagaaacttcacagaagaagaagcatgggatgattacaacaaaccgcttgttggtttaaagctatattttccttctcgcgtcgccacagcttcggttactacgagatacagagactggtgggctaaatcagtttcagaaatgcggaaagaatcaatggaaacttttaatgtaagcagtacagttgatcattatgatgatagtgatgatgatataccccttaagatagtaccattgagccaagtctatcagaagttggacgatgaaatgaagaaagccaagcattcgacaaacaagagacgcaagcgagctcgtgaggatgatgagagtgctgctgagacagaagatgacgagagtgctgacacggaagatgatgagagtgctgacacggaagatgatgagagtgctgagacagaagatgatgataacatgaccattgctcagaggatcaattctagaaagaagtctgatgacatagagaatactgaaggagaaagaagtagacttgtggcggataacaatgtttcaggccttcctcaaaagcttgcttatggagatgagacagtagcaacaacacaagaagaaacagagcaaaagaataatgaaaacaagtcttctaatggagtagctgctgagaaggaagaagatgatgagagattgaaacagagaaagcttgcaataaaggaactagctttgaagacggaagcacgaatgttgaaggtagagaacactttggcaaagattaaacaatggaaactcacaagacttcacaccaaaaaacctctagtttcttcttaagctatatcatctctatttgcagcgtcttctcttatcaaagacaaaagctttgtgtcataaaaatggcttttacgtacattcttctctgcaaaaatgataacttttggaatttag

SEQ ID NO: 63 - DNA, 1035 bp, Arabidopsis thaliana
actaccaattaaatctctctttttcttctcttaccattttcacattttcgagttttacaccaaagcctcttcactttctctctctctctactatagtctcctactacctactactacttcttctctctctctttcattcactacataaaaagcttcgagctcccatcactatataccctccaaagatgcaattttcaagaaactcaatccttaggcaactaagccgaaaagaaggttggagatcggcttctaaaaggtggacttccggagatagctcaacagccttcaacgacgacacaagtggtggtggttactcatcaatggagggtctttatggagtttactccggtggagacacggcggcgagaagtaagagagtgatggttgtagttgatgaaagttcgaggtctaagcatgctatgatgtgggctttgactcatttgactaacaaaggagatttagtgactcttcttcatgttgtgtctcctgatgatgaagctactccttctttggctcaatctcttggttctctttgcaaagcttgtaaacccgaggtggatgtggaggcattggtgattcaaggaccaaagctagcaacagtgttaagccaagtaaagaaacttgaagtctctgttcttgtgttgggtcagaagaaatctgcaccactcatctcttgcttatgtggacctagcagatcagaggagctcgtgaatcgttgcatcaacggtgcagattgtttaacgattggtgtgagaaaacaatgcaaaggtgttggtgggtacttgatcaatacacgatggcagaagaatttctggctcttggcctaatcacaattctaatcttattagataatttgtgttaattctgtgtttattgtagtttaataaactctatgtagtctctttgttgtcttatgttaacctaacttgtcttatatgtcttgtaagaaaaattaaagttgaatctttttatcccactacatcgattcctccgtagtctccaaattcttgtcccatataaacaaatacgttttca

SEQ ID NO: 64 - DNA, 807 bp, Arabidopsis thaliana
actcttgagaagctctcgattaagcttgaacttggaggatcaatggccgacgttcgcacacactcgcaccagcttcaagtgcaccctcaacgccagcatgaaggaggcatcaaagtcctttatcctcagagtggcccttcttccactcaggtgctagccgtgtttgtcggtgtaccgataggaggaacgctgctgactatagccggtttgacattagccggttcggttataggactaatgctagcattcccgttgtttctcatctttagtccggttattgtaccagcagcctttgtcatcggtctagctatgactggattcctggcttcaggggccataggtctcaccggactatcatccatgtcgtgggtactcaactacatccgccgggccgggcagcatatcccggaggagcttgaggaagcgaagcatcgtttggctgacatggccgagtatgtgggacagaggactaaagatgctggacaaaccatagaagacaaagctcatgatgtccgagaggccaagacttttgatgtccgagaccgagacaccaccaagggtactcataatgtccgagacaccaagactacataaagcgtgtgttttgagtgaaccatgttgaataaaaaaaatcgactgttagttcttaatgttcatgtgttttgagtgtttgtatttgcttgtaagcttattttgggtttagtttcctcttctttttttttcctgtaacaataatgtcggagacattttgcttctatcagttctttgttttattgatgcgtaatagatttgaaatgttagctgatt

SEQ ID NO: 65 - DNA, 602 bp, Arabidopsis thaliana
aaatatacactttgttatcaaattacaagtaatcaatcaaaagatggaaggcaaaactgtgatattcagtgtactcgtaatgggtctggtcatctcgcaaattcaagtagaagcacaaaaaacttgctgcccgagccagtcaactaggaaggagtttgaagattgcatttcagaaggaaatttgcagatactttgttcagctgaaagtggatgccgagacacttacgtgggttattgcccttcgggttttccttacgggagtctcacaaactctggtgatgttgtcaatgtatattgtaagttggggtgtgtatcctctctgtgtggtgccttaacgagtctccaaaaacttgacacaagtggaaaagtgaatgtcgcggttgaacgatgtaccaaggcatgttctactatatgcactaaaggatctaaaaccgcagttgaaactgtgtaaaaaagcagtcaagcataaacaagtaaaggggtggtcatgatcactaaaagtgtaaaagtgttgttttcatacaataattgtcgtgtatgtgtcaaacgtgctagactatggtgctagtactgtttaataaattgtttccggtttttttacg

SEQ ID NO: 66 - DNA, 2221 bp, Arabidopsis thaliana
acctaacaatgaccaccgtcgtttcctttctcgccctcttcctctttctagtcgccgccgtttctggtgacgtcatcaaacttccttctctagcttctaagttcttccgcccaactgaaaacgacgatgattctactaagtgggctgttctcgtcgccggatccagcggatactggaattatcgtcatcaggcggatgtttgtcatgcttatcagcttttgaagaaaggtggagtgaaagaggagaatattgtggtgtttatgtatgatgacattgcgaagaacgaggagaatccaagacctggagttattatcaatagtcctaatggagaggatgtctataatggagttcccaaggattacactggagatgaagttaatgttgataacttattagctgtgattcttggaaacaaaacggctcttaaaggaggaagtgggaaagttgtagatagcggtccaaacgatcatatctttatatactatagtgatcacggtggtccgggagtgctcgggatgccaacttctccaaacctatatgcaaatgatctcaatgatgtcttgaagaaaaaatatgcttcaggaacatataagagcttggtgttttatttggaggcttgtgaatctggaagtatttttgaaggtcttttaccagagggtttaaatatttacgcgacaactgcatcgaatgcagaagaaagtagctggggtacttactgtcctggagaggatcctagtcctccttctgagtatgagacctgtttgggtgacttatacagtgttgcttggatagaagatagtgaaaaacacaatttacaaacagagactttgcacgagcaatatgaattggtgaaaaagagaactgcaggttctggtaagtcttatggttctcatgttatggaatttggagatataggactcagcaaggagaagcttgtcctttttatgggtacaaatccagcagatgaaaacttcacctttgtgaatgagaattcaataaggccgccttcaagagttacaaaccagcgtgatgcggatcttgtccatttctggcataagtatcaaaaggcaccggaagggtcagcaagaaaagttgaagctcagaagcaagtccttgaagcaatgtctcacagacttcatgttgataatagcattctgttgattgggattcttttgtttggtttggaaggtcatgcggtgttaaataaagtccggccttctggagaaccgcttgttgacgattgggactgccttaaatctctggtgagagctttcgagaggcactgtggatcgttgtctcagtacggaataaagcacatgaggtcgattgcaaacatgtgcaacgcagggattcagatgaggcaaatggaggaggcagcaatgcaggcttgtcccaccatccctaccagtccttggagctctcttgaccgtggattcagtgcttgatcttcgtctccgccctatattaatcgatgtccattaatatcttactaccaattatactccttcctatgtagacaagatgttgtaaatatgggatgcttaagttcttgatgtcacagacaaaagaaacagtgattgtaagtagttgtttcaaataatctttgttgttcaagtgatttcaaggctttaagacaaattaacacatataaatgaggcttacaccataatacgtttacatggtacatatattgaggataacatctatcacaatttttctaattttgtaaaatacatatcaagtacaatacgcatagagaggattaaggcttagaggagtcatagcgtttacgttcttcttgtattgactggaaaattctggcagcattctcactcgcgagctttgcgttgtgaggtaccacctttatcactctcgtcactcctcccccatctcttgttgtctgagtaacagttgttcttgtcgtcgttgtggttgttgtcatcgtttgctcaggtgcattgttgatgttgctgtcctcatcaacggctgcgaatggccgaaaggacttgctaccagagattccctgtggcccacttggactgcttcctgtgctcccttgcctgctctttcttgctcgcggataagactttgttggctgttgctgttgctgtggagcaggttcattatcagatctctgttgttgttgttgggtgttctgaagatttccaggatgtccaaactggttcatttgctcattgggttgttgttgttgttgttgttg

SEQ ID NO: 67 - DNA, 1288 bp, Arabidopsis thaliana
ctttaacaaaacccaaatttctcaaaccctgattgttcgcctatagactcgatcttcgttttttttttgtcttaatcactcaataatatattgtctaaagtacattgtatatcattagttatgaattatgatgatatagctcgacatataaattaataatagaattcaaatgctcgctcgctgactgtagtaccctgatatcactagccaatacaacttacgaaaaaatgaaaaatgaaaaaaattttaaactcgaccaatcaatcgtccatggtatagttgtatcatcagacagcctttactaaggaaaaatgttataaattgggttcgtggccaaatttatgactttcaactgtcaccaaccttacattttgctatataaaccctaagaaactcattataaacttcaacaacataaaagacgatcaatataatctagaaaaaaaaaaagaagagagaagagagaaatgtcgagagctttgtcagtcgtttgtgtcttgctcgccatatccttcgtctgtgcacgtgctcgtcaggtgccgggagagtctgatgagggaaagacgacgggacatgacgatacaacaacaatgcccatgcatgcaaaagcagctgatcagttaccaccaaagagcgtcggcgacaaaaaatgcatcggaggagttgctggagtcggtggattcgccggagttggtggtgttgccggcgtgggaggtctagggatgccactcatcggtggtcttggcgggatcggtaagtatggtggcataggcggtgcagctggaatcggtggatttcatagtataggcggtgttggcggtctaggcggtgtcggaggaggtgttggcggtctaggcggtgttggagggggtgttggtggtctaggtggcgttggcggtctaggtggagctggtttaggcggtgtaggtggtgttggcggtggtattggtaaagccggtggtattggcggtttaggtggtctaggcggagccggaggtggtttaggtggagttggtggtctcggtaaggctggtggtattggtgttggtggtggtatcggtggtggacacggcgtggtcggtggtgtgatcgatccacatccttaatagagagtatttgttggttagggttttaattaaggaataattaattagtttcgatgttattgttggtcttttaattctgtgatcattagggtgacttttgatctattttctagtttgggcttttgtaacgtttgctttgatttcggccgtggtgttatgaaatgtgcgactctctatgtttg

SEQ ID NO: 68 - DNA, 2078 bp, Arabidopsis thaliana
gtcacatgtcaaaacagacactttggttctattggtttgggtttcggtcgtctgaggcccgaaagctgcttcttactcgaaagtcgaaacccttgtgagagaacttggtgatgccgaagatggtaactccgacgagtactggaaccagtttattgagccattcgcagaatctgagggtcaagtggtctcttctctctcattgctttatcttaattaagactttccaggtattgagtaatgtaatacacgtatctacatgaagatgaggatataaatatccatttatgagaaaagaaaaaaagggacaaacaaaagttggcaagtttaactaagtgaaaagtctatggcggagacaacgagttggatcccagtatggtttcctctgatggtgttgggatgttttggtctgaattggttggtcaggaaggtgaatgtgtggctctatgagtccagccttggggagaacaggcactatctgccaccaggtgatttgggttggcctttcattggcaacatgttgtcttttctcagagctttcaagacttctgaccctgactccttcactcgcactttaatcaaaaggtatggacctaaaggtatatataaagcacacatgttcgggaacccaagtataatagtaacaacatcagacacttgccggcgtgtgctgacagacgatgatgcgttcaagccaggttggccaacatctacaatggaactcattggaaggaagtcattcgttggtatctctttcgaggaacacaagcgtctcaggcgtttgactgctgctccagtcaatggccatgaagccctctctacttatataccgtacattgaagaaaacgttattactgttctggacaagtggaccaaaatgggagagttcgagttcttgactcatctgcgtaagctcacctttaggatcatcatgtacatctttctcagctctgagagtgagaatgtaatggatgcattggaacgagaatatacagctcttaactatggggttcgagcaatggcagtcaatattcctggatttgcttatcatagagcactcaaggcgaggaaaacacttgtagctgcctttcagtccatagtgactgagcgcagaaatcaaaggaagcagaacattttatcaaataagaaagatatgttagacaatcttcttaatgttaaagatgaagatggaaaaactttggatgacgaagagattatcgatgttcttctgatgtatcttaatgccggtcatgaatcctctggccacaccattatgtgggctaccgtttttctacaagaacaccctgaggttctacaaagagcaaaggctgaacaagaaatgatcctgaaaagtaggcctgaaggtcaaaaaggtctatctctaaaagaaacccggaaaatggaattcttatcgcaggttgtcgatgagacacttcgagtcataacattctcactcactgcttttcgagaggcaaagactgacgttgaaatgaatggctatttgatcccaaaaggttggaaggttttgacatggtttagggatgtccacatcgaccctgaagtctttccagatccaagaaaatttgatcctgctagatgggataatggtttcgtaccaaaagctggtgcgttccttccttttggtgctggaagccatctatgcccgggaaatgatctggctaagctcgagatttcaatttttcttcatcatttcctcctcaaatatcaggtgaaacggagcaaccccgaatgtccagtgatgtatctgcctcataccagaccaactgataattgcttggcaagaattagttatcagtaaaacatggttttcatcttctccgttaagttctagtgaaatgccgtcaagtttggtttatcagttataggagttcgttaactcttaagtaaatcaatcattgtcaaaaaaaaaagaaaagttaaacggtcttgagactgtctttttttttctcgttctgaaacttcatcagacttacatactctgttccatgaaacagagctttgttgtgttcatttgctataatacatatcgtttgccaaaaaaaaaaaagcttcataggtct

SEQ ID NO: 69 - DNA, 1497 bp, Arabidopsis thaliana
gccgctgctacaaacactttaatatatattgccaccgtcctaccatatatatatagtccacttaagatctttccactcatttataacccaaatttgttctgtttcataaatatgtgtcttccatttcgacccgtctcgaaaacatattattcgtcttcttcttcgactatcgtgacgcgtatggtaaactgcatactactttttgtattcattttgttggtctacctcctcatctcggcctcaagacttcaatctaaaaactctattcatgcatacttctcatcttctgatcaagatcaatctcagagcccgacaaaaatcgagcacatcgtctttgggataggctcaagcgcgatctcgtggcgtgcacgtagagaatacgttaagctttggtgggatgctcagaaaatgagaggctgcgtctttgttgagcgtcccttgccgtcttctcaaaaccacacagattcatatctccttcctccggtttgtgtttcccaagatacttcccggttcaggtacacttggagaggcggtgacagaaacgcgatccgaatcgcgcggtgcgttctagaaactgtcaggctattcaacacctcctcagaagaagtaagatggtacgtatttggagacgacgacacgattttcattcctgaaaacctcgctcgaactctctccaaatacgaccacacatcatggtattacataggatcaacctcggagatttatcaccagaactctatgttcggacacgacatggcgttcgggggtggtgggtacgctttaagcagctcattggctaatgttttagctagaaatttcgattcttgtatcgaacgatatccacatttgtacggaggagactctagggtttatgcttgtgtgcttgagcttggggttggattgtctaaagagcctggcttccatcagtttgatgtgagaggaaatgcattgggaatattgacatcacattcaacgagaccgttggtgtcactacaccacatggctcacattgacccaatctttccaaactcaaccactttctccgcggtccgccaccttttctccgccgtacaactcgaccctctccgtatttttcaactatccgtttgctacgaccgttggtactcttggaccatctccgtctcttggggatatactgttcagattgatggcaggcatttgtttctacgggatgttttgcgggcacaagagacgttccgaccatggcaaaaatcaggcggattagcaagtgtttacacattcaacacaagagagattcatcgtgatccttgccaacgacctgtcactttctacatgcaacatgtttcttctagtagccatgatggaaccattaaaagtgtttataagcaagcttacgagaattgcacctacgatcctgttacatcgcctcgcaaaattcatgagattagagtgttttcaagaagactcgatcccaatatcagacaacaaagtccattagagaaaatcattttctag

SEQ ID NO: 70 - DNA, 1843 bp, Arabidopsis thaliana
acataccacaaaatatctcataaagatcaaataaacactaaacctgaaagcaaaaaaatggcagcacgagcaacattcatattctatgctctcttcctaaccacactccaattccttctaacacaccatgtgtcatccgccgcccgaggattatggaaatacatcgcccccaacgtcggaatctccgcgatgcatatgcaacttctccataacgaccgtgtcgtaatgtacgaccgaaccaacttcggaccatcaaacatctctctacctaacggtaactgccgtgacaacccccaagacgccgtctccaaaatcgactgcacagctcactcgatcgaatacgacgtcgcaacgaacaccatccgacctttaacggtacaatccaacacatggtgctcatccggttcggttcgaccggacggtgttcttgtccaaaccggtggagaccgagacggagaacttaagacaagaaccttttctccttgtaataacaatcaatgtgattgggtcgaaatgaacaacggtttaaaaaagagaagatggtacgcttccaaccatattcttcccgacggtaaacaaatcgtcatgggaggtcaaggacaattcaactacgagttctttcccaaaacgacaaaccctaacgtagtcgcgttaccgtttttggccgagactcatgatcaaggacaagagaataatctttatccttttgtgtttatgaataccgatgggaatctatttatgttcgctaataacagagcgatattactcgactatgttaagaacacggtggtgaaaacttttccggcgattcccggtggtgatccgagaaactatccgagcactggctcagccgtgttattaccgttaaagaatcttgaagcggataatgtcgagacggaggttctagtgtgtggaggtgcaccaaaaggatcatacaacctcgctagaaagaaaactttcgtgaaagcgcttgacacgtgtgcaaggatcaagattaacgatgccaaacctgaatgggcggttgagaagatgccacatgctagagttatgggagatatgattcctttgccaaacggagatgttttgctaatcaacggtggatcttttggtactgctgcatgggagcttggtcgtacaccggttttagcaccagacctataccatcccgagaatccggttggctctaggtttgaatcgctaaggccgactacaatcccgagaatgtatcactccgcggctattcttctacgtgacggtagggttttagtcggaggaagcaatcctcatgcgttttataactacaccggagtgcttttcccgacggagttgagcttagaagctttctctccggtttacctacaacgggagttttcgaatcttcgtcccaagattatatctcctgaacctcagtcgatgattaaatatgggacgaatttgaagttgaaattttcggtcaccggagaagttacgactccggcgaaagtgactatggtatttccgacgttcacgacgcatagcttcgcgatgaatcagagggttttggttttggacaatgttaagtttacgaggaaaggcaaatcgccgatgtatgaggttcaagtgaggactccgaggtcggcgaatattgcatggcctggttattatatgatttttgtggtgaatcaagacataccaagcgaaggtgtttgggtaaagttagaatgattcattgacttttatttaatatctttatttttgtgtgtaattgtgttatattactgatatcaattgtatatgaatgtaataagaatatgtcttctcaacttgatgataataaattaattaactactctttttctatgtc

SEQ ID NO: 71 - DNA, 1905 bp, Arabidopsis thaliana
aatatcccacatctctactcatccacattagtcaaagatctctattggtacttctcaaatggatcacaaaatcctactaacacctcccaaatctttatacaccaaatgtatcataaccatcatttacgtcgtatcaatatctcatctaaatgcccatttcataacttcatgcaaacaaaccccataccctagcgtctgcgaccaccacatgtctaattcacctctcaaaactttagacgaccaaacggatgggttcactttccacgaccttgtggtcagctccaccatggaccaggccgtgcaactacaccgccttgtctcttccttgaaacagcatcattctctccacaaacacgcaacatcagctttgtttgactgcttggagctctacgaagacactatagaccaactcaaccactctcggagatcgtacggtcaatattcttcgccacatgatagacaaacctcgttaagcgcggccatagctaatcaagacacttgcagaaacggatttagagattttaagttaacctcttcgtattcaaagtatttcccggtacaatttcacaggaatctcactaagtctattagcaactctttggcagttactaaggctgctgctgaggctgaggcggttgccgagaaatatccatcgacggggttcactaaattcagcaaacaaagaagtagtgccggaggtggtagccaccggagattattgttgttttccgacgagaaatttccatcgtggttccctctttccgaccgtaaactactggaagattccaaaactacggcaaaagccgatcttgtggtggctaaggacggttcgggtcactacacaagcattcaacaagcggtaaacgcagctgccaaacttcctcggagaaaccagagacttgtgatatacgttaaagccggcgtttacagagaaaacgtggtaatcaagaaatcgatcaagaacgtgatggttatcggagatggcatcgattctaccatcgtcaccggtaataggaacgttcaagatggcacgacgacgtttaggtccgcaacttttgctgtttccggcaacggttttatcgcacaaggcataacattcgagaacacggcaggaccggagaaacatcaggcggtggctctccgatcaagttcagacttctccgtcttctacgcctgctctttcaaaggctatcaagacactctctaccttcattctagtcgtcagttcttgagaaactgcaatatttacggaaccgtcgatttcatcttcggagacgcaaccgccatcctccaaaactgtaacatctacgctcgtaagccgatgagcggccagaaaaacacgatcaccgctcaatcacgcaaagaacccgacgagactactggcttcgtcatccagagctcgacggtggctactgcgtcggaaacttatttaggacggccgtggagatcgcattcgaggacggttttcatgaaatgtaatcttggagcgttggtgagtccggcgggatggttgccttggagtggtagttttgctcttagcactctttattacggtgagtatggtaataccggcgccggagcaagtgtctccggtagagttaagtggccaggttatcatgttataaagacggtgacagaggcggaaaaattcacggtggagaatttcttggacggaaactattggattacggctacgggagtaccggtcaacgatggactttgatttttttcttaaaagaattaattttgttagtgtggtctttgttgattttatgttttttttgtttgttggcgtataattgttatatatagctttatttcccaaatcccatgtaacagatggattgtcttgaatctatatagtatctataatagcaaaccgattgactcgctcttggaagattt

SEQ ID NO: 72 - DNA, 3299 bp, Arabidopsis thaliana
agacgtagaagaagaagacaaacgtgaacgtctttaaattatgaaacctctttcttaaagttctcaagaggtgctcaacaatggcggatcaatctcttctacactctccgatcaacccacatttctttcagcctattcttacagaatctcgcactcacctcaacattcctgtagctttcttctcgaagcatgttgaaggaagaaacaaccaaaacaagactgtgacgctaagatcagacgcgtcggataaaacttggttagtgaagatggacggtctaaaactaaccgacggatgggaagattttgcctttgcacatgatcttcgaactggtgacatcgtcgttttcagacttgaaggagaaatggtgtttcatgtcacagctttaggaccaagctgttgcgagattcaatatcatacatcatctcacaatatcaatgatgatgatcgtaatgatcagatcaacattgcttcaagaaacagttcaagagtgaagaagaatccacgaaagaaagtagagtcttctttagaccattctcgttttgtggcaaaagtctcagcttggtgcctaagcaatgatagactgtatataccactaagtttcgccaggttaaacggtctgaacaaaatcaacagtaagaaaatctatcttcagaacgaagaaggaagatcatggaagttagttttgagacatgacaaatcaggcatgcaaacttttgtccaatccggttggagaagattctgctctgaaaatgggattaggcaaggtcaatatacattcaaacttgtccgaaaatcagcaccacctgtcatccgtttgtgccgcgcaaaagctaaaccaaaacaaagatcagttgcagaatattcatcagaccattcttgttttgagggatctgtcactccttcaagcctaagaaatgatctactgtatcttccaaggagctttgtgaactcaaatcgtctggacaaaagatgcagtgagatagttttaaagaatgaacagggagtaaaatggcctttagttttgaaacgtttcaaatcagtcacttatctcccaaaaggctggactagtttctgtcaagtaaacaggatcaaagcaggagattcattcaagtttaaactggttggaacctggaaaaaacctgttctttctttgtgtccgacacaatccaacaatcacaaaactccattagagtgttcagaaggtaacaaatccgaagaaagtgaagaggattgcttggaggtaaagaaaaagaagtattggtcgagatgcagagcttctgtagaaaacatggatgatgatcagaccaacattggaaacagttcaagaaagaagagagtgagtaagaatccaagagagaaagtagagtcttcatcagaccattctagttttgtgggatctgtcaatccttcaagcctatacaaagatcaactgtatcttccaaggaattttgtgagctcaaattttctggacaaaagatgcagtgagatagttttaaagaatgaacggggagaaaaaaggactttagttttgaaacacttcaaaaaagaccttacttttctcaaaaaaggctggactagtttctgtcaagtaaataggatcaaagctggagattccttcaagtttaaactggttggaacatggaacaaacctgttctttctttgtgccctacagaaaccaactatcacaaaactccattagcgtgttcagagggtaacaaatccgaagaaagtgaagaggagggtactgaagacaagaatacctcacaagattgcttggaggtgaagaaaaggaagtattggtcaacatgcagagcttctgcagagaacatagatgatgatcagaccaatattggaaacagttcaaaagagaagagagtgaagaaaaatccagtaaagaaagcagagtcttcatcagaccattctagttttgtggctaatgtcacagcttcaagcctaaactatgatcgactgtatttaccactaagtttcgtgagttcaaacggtctagataaaatgaacggtaaggagatcgttcttcttaatgaagaaggactatcatggaagtttaatttgaagtacaaccaagcaggcaagcatacttatgtcagacctggttggtcaagattctgtgatgcaaatgggatgagccaaggtcaacaatttacattcaaactggtccaaaaacatggaccacctgtcatgtatttgagcctcagtgaacatagaccaaagtcagaatcttcatcgcaccgttcctattttgtaggatctgtcactgcttcaagcataaagaaagataaactgtatttatggaagagttttgtgagctctaatggtctggacaaaggatgcaagaagataattttaaagaataaatggggaagagaatggaaattagtcttgaaacactacaaatcaaactgctttactattatcaaacgaggctggaccagtttctgccaaggcaacggtttgaaagctggagattccttcaagttcaaactggttggaaccggggaaaagcctgttctttctttgtgccctgcagaatccagccatgaaaaaattccattagagtgtccagaaggtatagatgatgtcaattcactctcctcaaatcctagcagtggagatgacagtagtagatccgaagaaagcgaagaggagaatatggaagacaagaacatctcacaggattgcttggaaaccaagaaaaggaagtattgctcttcatcgtcatatagtcaaaaccgatttgtgacattaactcttacacggtccgcttttcaaacctataaactggtaagcttcttcaacaactatgcctcaaggttgtcttagtatattattttgccacaaaatcatttttttgcagtttcttccgcgcggtttcacgcaggtgaatggcatcaacaagccaaggaagataactctgctgggtcaagatggagttaaaaaggtggtggatctctatcaggaaagtagtagcagaataatgagatttggaaaaggctggagagagttctttgatgctcaaggcgtgaagatagacgactcctttgtgttggaactcatttgggagaaagaagcaagtccggtgcttaagttctgcaccaaagtaccaaagtaaactctgcttgagactgtttccagagaagtagcttgtggtgtgtctcaacacattctctcattccctcgatttctttagcttttgcaactcttgactagatgtctacatatctgagtcttgtttaagagttgaagaaaatgttacgacttaactacttgtgtgttgtg

SEQ ID NO: 73 - DNA, 1445 bp, Arabidopsis thaliana
atggcatctttagattctcttccggcgatgaagctcgtgagattcatattatctacccttttggtcacttctgtgaactcgcaaacgcaatgccggaatttcaaatcaatcattagtttcggagattcaattgctgacactggaaacttgcttggtctctcggatcctaacgatcttcctgcttccgcgtttccgccatacggagaaaccttcttccaccacccaaccggtcgttactccgacggccgcctcatcattgatttcattgctgaattcttggggtttccgcttgtgcctcctttttatggatgtcaaaatgcaaactttaaaaagggagttaatttcgcggtcgcgggagcaactgcattagaaccttcctttctagaggagagaggaattcattctactatcaccaacgtcagtctaagcgttcagcttaggagcttcacggaaagtttacctaacttatgtggctcaccttcagattgtagagatatgattgaaaatgctttgatactcatgggagagatcggaggaaatgattataattttgcactcttccaacgcaaacccgttaaggaagttgaagagctggtaccgtttgtgatcgctactatttcttctgcaatcacggaattggtttgcatgggaggaagaacattcctagttcctggaaatttcccgatcggatactcagcatcctatttgacattatacaaaacatcaaacaaggaagagtatgatcctctaacaggatgtttgaaatggcttaacgatttctcagaatactacaataagcagcttcaggaagaactcaacggactcaggaagttgtaccctcatgtcaacatcatatatgctgattactacaacgctttgttgcgccttttccaagaaccagccaaattcgggtttatgaacagacccttgcccgcttgttgcggtgtaggaggatcttacaacttcaactttagtagaagatgtgggagtgtaggagttgaatactgcgatgatccttcacagtatgtgaattatgatggcattcatatgacggaggcggcatacagattgatatctgagggcttactcaagggaccgtatgctattcctcctttcaagtggtcttgcctcagctccgagattatgaataagatgtcattagatactcagattcttgatgaacagctactacaaggttgtctgaaagtttgagagacaagagaaagagtggaaaaaacatataggttcttaagtgtttgtgtcttcttcttttttgttccgggtaacggtgttaattagccttaggtgcatcatgcatgtgttggatcatgtattatctttgtattgtattgttttcgttagtttgggtaagagttagtatccttaattgttggaccatgtacactgtcatatataatttaactatatacaaaacaattaaatgc

SEQ ID NO: 74 - DNA, 1152 bp, Arabidopsis thaliana
atggagaccgtagtggtgattgtgggagctggaccggccggtttagcaacatcggtttgtctaaaccaacactcaatcccaaacgtgatcctcgagaaagaagacatctatgcatccctttggaagaaacgagcgtacgatcgtctcaaacttcacttagccaaagaattttgccagcttcctttcatgccacacggtcgtgaggttccaacctttatgtccaaagagcttttcgtcaactaccttgacgcttacgttgcccgtttcgacatcaaccctaggtacaaccgtaccgtgaagtcctcaacgttcgatgagtccaataacaagtggagggtcgtggccgaaaacacggtaaccggagaaaccgaggtgtattggtcggagtttctggtggttgcgaccggggagaacggagatgggaatattccgatggtggaggggattgacacttttgggggagagattatgcactcgagtgagtacaagtccggtcgtgattttaaagataaaaatgttcttgtggtcggaggtggaaattccggtatggagattagttttgatctttgcaacttcggagctaatacgaccattctaattagaactccaagacacgtggtgactaaagaagtgatacacttggggatgacacttctgaagtatgctccagtggcgatggtcgacacattggtgacgactatggcaaaaattttgtacggagatctctccaagtacggactcttccgaccaaaacaaggtcctttcgccaccaaactctttaccggaaaagctcctgtcattgatgttggaactgtcgagaagattcgcgatggcgagattcaggttatcaatggtgggattggaagcatcaacgggaagaccttgacgttcgaaaacggacataaacaagatttcgatgcgattgtgtttgctactggttacaaaagctccgtttgcaattggttagaggactatgaatacgtgatgaagaaggatggattccccaaagcaccgatgccaaaacattggaaaggagagaagaatctttactgtgccggattttcaagaaaaggaatcgccggaggtgctgaggatgctatgtctgtagccgacgacatcagatctatcttggctaccttaaaaaataattga

SEQ ID NO: 75 - DNA, 225 bp, Arabidopsis thaliana
atggctaatattgttggaaacactagtgtatctactcgttttaaagagctgattcgtgaaatgacgcagctgaatgaagaaattcagaagatcgacgtgaatgattttcgtgccattagagaagccaggaagaagataactggtatgacaacgaagttggacgagctcttagagatgatgaaagaaactgtgaaggagaagaaggaaaccccacatccagagtga

SEQ ID NO: 76 - DNA, 2636 bp, Arabidopsis thaliana
tcctaataaagatctaatggaaaccaatccaagaaaactaagatcatattcctacatatgtttaatagtatgtatatttgtattggttgtttgtgcaatattgtccagagcagaagaaaaagaaggaaaaggcgaaaacgatgatcatataccaaagatttactctattttggttgaaggtgaaccattggcctttcgagcttctactaatatcaacagcaaagctatggcgttagaagcaaagaagatagaagagattcatgacgaaatacttggaagcacacttgaaaagggaagttatacaaagctttatagcttcaaacatgtcatcaatgctattgcagtccgtaccactgcttctcaggccaagaaactcgggaaaacaaaaggagtgaaggcagtagaagaagacaaaggagtgaaactaatgacaacatacactcccgatttcttggaacttcctcaacaagtctggcaaaagatctcaaacgaaggagacagacgtgctggagaagacatcgtgatcggtttcgtggacaccggaattaaccctactcatcctagcttcgccgcacttgatctcacaaacccttactcatcaaatctctcacgtttgcatttctccggtgactgtgagatcggtcccttttttccacccggatcttgtaacggaaaaattatctccgcaaggttcttttccgccggagctcgagcttcaggcgctcttaactcctccttggatatactctctccgttcgatgcgtccggccacggaagccacgtggcatccatcgcagccgggaacgctggagttccggtgatcgtcgacggattcttctacggccgtgctagcggtatggccccacgttcacgaatagccgtctacaaggcgatttatccatcaatcggaactcttgttgacgtaattgcagccatcgaccaagcaattatggacggcgtagatgtgttgacgctatcggttggaccagacgaaccaccggtggataagcccacggtactcgggatattcgacctcgcaatgctattggctagaaaagccggcgtgtttgtggtgcaagccgtagggaataatggcccgtcgccgtcttctgtgttgtcttatagtccgtgggtcgtcggtgttgctgccggaaatactgaccggtcttatcctgcccccctcatcctcgacggtggccaaaccgttcagggcgttggactatcaggtccaacccttggagctccattagttcaacacagacttgtcttagccaaagacgctgttagaacaaacggctcggttctacaacccttaaccagagacattgaagaatgccagcggccggagaattttgaccctgccgcagtttttggaagtatcgtgatatgtacattttctgatggcttctacaatcagatgtcgaccgttcttgccatcacccaaaccgccaggactcttggtttcatgggttttatactcattgcaaatcctagattcggcgattatgttgcagaaccagtgatattttcagctcctggtattctaatccctacagtatcagctgcccagattattttgagatactacgaagagaaaacctttagagacacgagaggagtggcgacacaatttggggcacgtgctagaataggcgaaggccgaaactcggtcttcgccggaaaagcaccggtggtgagcagattttcttcgagagggccagcttttattgatgcaactcggagtcctttagatgtacttaagccagatattcttgcacctggtcaccaaatttggggtgcttggagcctccctagtgcctttgatcctattttgacaggacgaagctttgccatattgtcgggaacaagcatggcgactcctcatatagcagggattggtgcgctcataaaacaacttaatccttcttggactccagccatgattgcatctgccatctccaccacggctaacgaatacgatagtaatggtgaaattatatcagcggagtattatgagctaagtagattatttccatctaatcattttgatcatggtgcgggccatgttaatcctgctagagccctagatcctggactagttttacccgctggttttgaagactacataagtttcttgtgctcactgccaaacattagcccagccactatccgagacgcgacaggagtcttgtgtaccactacgcttagccacccagcgaaccttaaccatccgtcagtaactatatctgcacttaaagagtcacttgtggtgagaagaagtttccaagacgtctccaacaagactgagacatatcttggttcggttttacctcccaatggtacaactgtacggttaaccccaacttggtttaccgtaccaccacagaaaactcaagacctagacatcgaattcaatgtcacacaagtcttaaacaagtttacatttggtgaagttgttcttactggaagcttaaaccatattataagaataccgttgtcagttaaaaccatttgaaaacataaaattttattgttacttgtcgatctcacttaaaataaggtctttattcttaaaaatttccaacgaaaaggttattgacactccatcaaataggaacggagataagttttttcat

SEQ ID NO: 77 - DNA, 1439 bp, Arabidopsis thaliana
tttgagcgagacgaggttcaacataatgtccattacaaacaacaacagcatcataaatctcatcacgacgaactttcttctctttctccgtcgattcaatcctccacttcccgattccttcctccgccgccggagaaaccttcacaacctccgtctcaaacctaaccatctcctcaatcccaaactccttagcgaaatctttcaaatacgccaaaacttcgccatgactcggaaacctcctcggatctctagacacaccggaacgaaccacgaacgggaaatctctgtatccggtacactctcgtgtaccgttgattcgtagagatctatagacgcttgaatgaacaacggatcgggtcgggtcaacacttaacggatccgattcgacttcatcggtgtagatccaggttcctccgacttgtttttgtttctcgaaaacgaccaccgagtgaccttctcgtcgaagctctcgtgccgctactagacctgcaggtccagcaccgataaccgccacgtggtgtgatctggttggtgataatgcagcaggtattgaagcaattggagccatggtgtgaacttaaagataaagtggttcttgtgacaggtgcttcatctggtatagggagagagatctgtcttgatctatgcaaagctggttgtaagattgtagcagcagctcgtcgtgttgatcgtctcaactctctctgttctgaaatcaacagctttggtgcaatcggagtccaagccgcagctcttgagctagacgtttcatcagacgcagacactattcgaaaagcggttaaagaagcttgggaaatctttggaacgatcgatgttttgattaacaatgctggaatcagaggcaatgtcaagtctagtttggatttatcaaaagaagaatgggacaaagtctttagaaccaacttgaccggatcttggttaatatccaaatacgtctgccttttgatgcgtgacgctaagcgtgggggctcggtgattaacgtctcgtcgatctctgggcttcatcgcggtttgttgcgcggtggactagcgtatgcttgttccaaaggtggtgttgacaccatgacgaggatgatggctattgagttagctgtttataagatcagagtgaactcgatcgcacctgggattttcaggtcagagatcacacaaggtcttttccagaaagagtggctcgagaaggtaacggaaaagattgtaccattaaagatgcaacagactgtggatccggggcttacatctctcgttcgctatctcattcacgattcttcccaatatgtcaccgggaatacatacatagtcgattccggagctacactccccggtgtgcccattttttcttctctttgaaaatcttagtcaaaatcttctgtgcttgtacatacaccgtgataagaatgatgtcttttccaataaat

SEQ ID NO: 78 - DNA, 1436 bp, Arabidopsis thaliana
tttgagcgagacgaggttcaacataatgtccattacaaacaacaacagcatcataaatctcatcacgacgaactttcttctctttctccgtcgattcaatcctccacttcccgattccttcctccgccgccggagaaaccttcacaacctccgtctcaaacctaaccatctcctcaatcccaaactccttagcgaaatctttcaaatacgccaaaacttcgccatgactcggaaacctcctcggatctctagacacaccggaacgaaccacgaacgggaaatctctgtatccggtacactctcgtgtaccgttgattcgtagagatctatagacgcttgaatgaacaacggatcgggtcgggtcaacacttaacggatccgattcgacttcatcggtgtagatccaggttcctccgacttgtttttgtttctcgaaaacgaccaccgagtgaccttctcgtcgaagctctcgtgccgctactagacctgcaggtccagcaccgataaccgccacgtggtgtgatctggttggtgataatgcaggtattgaagcaattggagccatggtgtgaacttaaagataaagtggttcttgtgacaggtgcttcatctggtatagggagagagatctgtcttgatctatgcaaagctggttgtaagattgtagcagcagctcgtcgtgttgatcgtctcaactctctctgttctgaaatcaacagctttggtgcaatcggagtccaagccgcagctcttgagctagacgtttcatcagacgcagacactattcgaaaagcggttaaagaagcttgggaaatctttggaacgatcgatgttttgattaacaatgctggaatcagaggcaatgtcaagtctagtttggatttatcaaaagaagaatgggacaaagtctttagaaccaacttgaccggatcttggttaatatccaaatacgtctgccttttgatgcgtgacgctaagcgtgggggctcggtgattaacgtctcgtcgatctctgggcttcatcgcggtttgttgcgcggtggactagcgtatgcttgttccaaaggtggtgttgacaccatgacgaggatgatggctattgagttagctgtttataagatcagagtgaactcgatcgcacctgggattttcaggtcagagatcacacaaggtcttttccagaaagagtggctcgagaaggtaacggaaaagattgtaccattaaagatgcaacagactgtggatccggggcttacatctctcgttcgctatctcattcacgattcttcccaatatgtcaccgggaatacatacatagtcgattccggagctacactccccggtgtgcccattttttcttctctttgaaaatcttagtcaaaatcttctgtgcttgtacatacaccgtgataagaatgatgtcttttccaataaat

SEQ ID NO: 79 - DNA, 1427 bp, Arabidopsis thaliana
tttgagcgagacgaggttcaacataatgtccattacaaacaacaacagcatcataaatctcatcacgacgaactttcttctctttctccgtcgattcaatcctccacttcccgattccttcctccgccgccggagaaaccttcacaacctccgtctcaaacctaaccatctcctcaatcccaaactccttagcgaaatctttcaaatacgccaaaacttcgccatgactcggaaacctcctcggatctctagacacaccggaacgaaccacgaacgggaaatctctgtatccggtacactctcgtgtaccgttgattcgtagagatctatagacgcttgaatgaacaacggatcgggtcgggtcaacacttaacggatccgattcgacttcatcggtgtagatccaggttcctccgacttgtttttgtttctcgaaaacgaccaccgagtgaccttctcgtcgaagctctcgtgccgctactagacctgcaggtccagcaccgataaccgccacgtggtgtgatctggttggtgataatgcagaagcaggtattgaagcaattggagccatggtgtgaacttaaagataaagtggttcttgtgacaggtgcttcatctggtatagggagagagatctgtcttgatctatgcaaagctggttgtaagattgtagcagcagctcgtcgtgttgatcgtctcaactctctctgttctgaaatcaacagctttggtgcaatcggagtccaagccgcagctcttgagctagacgtttcatcagacgcagacactattcgaaaagcggttaaagaagcttgggaaatctttggaacgatcgatgttttgattaacaatgctggaatcagaggcaatgtcaagtctagtttggatttatcaaaagaagaatgggacaaagtctttagaaccaacttgaccggatcttggttaatatccaaatacgtctgccttttgatgcgtgacgctaagcgtgggggctcggtgattaacgtctcgtcgatctctgggcttcatcgcggtttgttgcgcggtggactagcgtatgcttgttccaaaggtggtgttgacaccatgacgaggatgatggctattgagttagctgtttataagatcagagtgaactcgatcgcacctgggattttcaggtcagagatcacacaaggtcttttccagaaagagtggctcgagaaggtaacggaaaagattgtaccattaaagatgcaacagactgtggatccggggcttacatctctcgttcgctatctcattcacgattcttcccaatatgtcaccgggaatacatacatagtcgattccggagctacactccccggtgtgcccattttttcttctctttgaaaatcttagtcaaaatcttctgtgcttgtacatacaccgtgataagaatgatg

SEQ ID NO: 80 - DNA, 1641 bp, Arabidopsis thaliana
atggaaggaacaatgaggtgctcagcgaattacgtcccgctttctccgatcagctttctcgagagagctgctgtcgtcttcggctccagaacctctgtcgtgtatggtgatattcagtacacgtggcaccaaacacgtgaccgttgcgtccgccttgcatctgctctctctgaccttggtctctctcgccatgacgttgtggctgctttagcgccaaatgttcctgcgttatgcgagctttattttggagctccgatggctggagcagtactttgcgtgttgaacacgacattcgattctcagatgcttgcgatggcgctggagaaaacgaagccaaaagtattcttcgttgactctgagttcctctctgtcgctgaagaatctctcagtctcctctcaaacattgaagaaaaacctctcatcatcacaatcacagaaaatccaacagagcaatcaaaatatgaacaatacgaggattttctctccactggaaaccctaatttcaaaccaatacgaccagttgacgaatgtgatccaatcgccctcaacttcacatctggaaccacatcgactcccaaatgtgtcgtctatagtcatcgcggtgcctatctgaacgcaactgctgttggtgttatgaatgagatgaaaccaatgccggtttatctatgtacagttcctatgtatcattgtagcgggtggtgctatatttggacagttacggcttttggaggagtcatcgtctgtctcagggaagtcaacgacgaagttatatttgatagtatcgtgaagcacaaggtaactaactttggtggctcgcctccggttctcaacatgattgctaatgcaagagactcggtcaagaagtcgtttccatggaccgtacaggttatgagcggaggatcctctcctcctgaggtcatgttgaaactcaagaagctaggattcaaagtgatgatggcttatggatgctcggaggtgtatggactaggaacagcttgtttgtggatgcccgagtgggagactctacctgaagaggagagtttaaggctcaaggcaagagatggtctcaaccatttcgccaaggaagctgtcgatgtattggacccaaccaccatgaaatcggttccacacgacggaaagactatcagggtaattgctctccggggaaatacagtcatgagcggttacttcaaggacaaggaagccactgaagcggcttttcgaggtggatggtactggagtcgcgacatgggtgttatagatcctgatggctacatacaatttaaagataggtcacaagatgttataacatgcggaggagaaatcgtgggatcaaaggagatcgaagggattctctatagtcacccggcggtttatgacgcaggggtcgtgggtcgaccggacgaaactttaggagaatcgatgtgtgctttcgtgaagctcaaagaaggagctgaagcgagagaggaagagatcattgagttctgcaagagaaagcttgggaataagaacatgaagatgattccaaagacagtagtcttctcggatgttcctaagactcccactgggaagattcgaaagaatgttctgagaaagatggccaaggatatgggttatgttcaattgagagctgtggagtaa

SEQ ID NO: 81 - DNA, 1539 bp, Arabidopsis thaliana
ctctctctctctccatttaccatgactttcaataagaggcaagtcaagatcaatcactggccggagaagaacgacaaagagaagcagaaatactccaaaaacagagaaaccgtcaagttgacacttctcactcttcttctcctttgctcaatttgtttcctcttcctaactctcaatttccccttcacaatagaattcacagcctcaatccctcgcacatgcgaccacaatttcaccgtctacgtgtacgatctccccaaagagttcaacatcggtctcctccaaaattgccgacacttaaacatctacaccaacatgtgccctcacgtggccaacaatggccttggacagcctcttcaccgcggacgaacttcgtggttctctacgcaccagttcatagccgagatgatcttccacgcacgtgtcgaaaaccatccatgccgcacgtatgagccagacactgccgacatcttctacgtccctttctacggtggtctctacgcttcaagcgtgttccgagagcaaaacctgaccaagcgcgacgagctagctgtcagattagtcaactacattagtggccaacgatggtggaagagaagcaacggtcgtgatcatttcttggccatagggaggacagcttgggatttcatgcgctcctccgacactgactttggagctaacatgctcatgcaaatgccacgtgtcatgaacatgtcggtgctgaccgtggagaggcagccttggaatggtgacaatcactttggtataccgtatccttcttattttcatccgtacacgtcagcagaaatggtgacgtggcaggacaagatgaaaaatgtcgagagaccaaacttgtttagttttgtcggtgggccgagaaagggcttggagaaagctgccattagagacgagctgatcaagcaatgcgctgagtcgagccattgtgagcttctcaagtgtgaaaatggagggtccaggtgtcacaacccaatgacggtattaggagtgatggctaggtcacggttttgcctacaagcaccgggggactcattcacgcggagatcaacattcgatgcgatgttagccgggtgcataccggtctttttttcaccccacactatgtatacacagtacatgtggtatcttccggacgataaaagaagttactcagtgttcatggacgaaaagaacaacactcatatagaacaagagctcttgaggatctcggagaacgaagtggttcaaatgagagaaatagtcatcgatttgatcccgagactgacttatgcgcacccaaactctactaactatgatttaccagatgcggttgatatagcgttagaggcactagctaagcaagcaagagacaatgttgtggtttcattgtaagacctatagttttgtgctactcagatgtaactaatcccaaagaataaagaattgtagtgttcagacatcaagccaagcaactattgaactatggacattggcaatatgaaacatgcaacttaagacaaatgacagttatagaaacacgct

SEQ ID NO: 82 - DNA, 1220 bp, Arabidopsis thaliana
aagtaaaatgaacacaaacagaaagaagatgaaagtccatattggaggatatgtgttgatacttgccttgacggtttctgttatattacagcagcctgagttggtcactggacaagctagagttcctgctatgtttgtacttggagactcattggtcgatgctggtaacaacaactttctacaaactgtagctcgagccaatttcctcccttatggcatcgacatgaactaccagcctactggcagatttagcaacggcctgactttcattgatctgctagctcggttgttagaaattccatcaccccctcccttcgcggatccaaccacatcaggcaatagaatcctccaaggagttaactacgcgtctgcagctgctggcatcctcgatgtatcaggctacaactatggtggaagattcagcctgaaccagcaaatggtgaatctagagacgacactaagccaactgcgaacgatgatgagtccccaaaactttacggattacttagcaaggtcgcttgtggttctcgtttttggaagcaatgactatatcaacaactaccttatgcctaatctctacgattccagcataagattcagaccacctgactttgccaatctacttctcagtcaatacgctcgccagcttctgactctttacagcctaggtctaagaaaaatatttatacctggagtagcaccactaggctgcataccaaaccaacgagccagaggtatctcgccacctgatagatgtgttgacagcgtgaatcagattctaggcacatttaaccaagggctaaagtcacttgttgatcagctgaaccagcgatcacctggagccatctatgtatacggcaacacctatagcgcaattggtgacatcttaaacaacccagctgcttacggatttagcgtagtagacagggcttgttgcgggattgggaggaaccaaggacaaattacatgtctgccgttgcagactccttgtcccaacagaaatcagtatgtcttttgggatgcattccatcctactcagactgctaactccattctggctagacgagctttctatggtccaccttccgacgcatatcctgtcaatgtccaacagatgacactccttcactagtatattttggttttcgtgtttctttgaagttgtatgttataatgattgaacctatctatctatgagtatcgagtatcaagttgaaacc

SEQ ID NO: 83 - DNA, 1247 bp, Arabidopsis thaliana
gtgttttggttactatacttgtgtgccacttgggttctagggttccacgccatctgaatgatctgactcgttcgaattgcaaagtagtcttagaatggagaaagaagctgataacaagttcagatgggtgattaaaaatttctcatctttgggatccgagagagtcttttctgatatattcgtagttggttcttgcaaatggcgtcttatggcctatcccaaaggagttagggataatagatgtttctctctgtttctggttgttactgatttcaaaactttgccttgtgactggaaacgacacacaagattgcgcctaaatgttgttaatcaactctcggaagaactttccatactgaaagaaacacaaatgtggtttgatcaaaagactccggcctggggtttcttagcaatgcttcctcttaccgaacttaaggctgaaaatggtgggtttctggtgaatgaagaggtcaaaattgttgtggaggttgatgttgttgaagctcttggcaaattagaggaatctgaagaggcaacacaacctctgaaaaaggtaaagctagaggcttttgtggaatcgaaaggtttgcttaaggaaacttcatcagtaaaggaagaaatcattgatgtcaatgtgtttcatgttcttccttcccaggtggaatttgtaagccgtgtttttgaaagatacccagaaattgcatcaatattccaagcaaagaagcaacatttgagaacagcatgcatgtatgtcctcctaagtcttattgagacactgtgcaagtcactggaagagctctccaatgatgatcttgtgggaggagacaatgcgttacaatacctgaagttttctggctttaaggttgattggttggagaagaagctggaggaagttaaggaaaagaagaaggaagaacagattggtgaaactcgtatgcaagaaatgaaagtttttaagcagaagtgctcagatatagaagctcttatggagagagagaagtcaaagttgttggtcaccagaggttctcctctaacgttggatgatgttctttgaagacttacgttctctactacgtttgttctggtactgtgcgtttgctgtctaggtttcaaaataagagacttccccatgaaataagaagttcccattgtaaagacctttaacgcaagttttttggttatagatgttagcaaaaatctgtctttaacgctagttttcaattgttataagaagctgaggattattt

SEQ ID NO: 84 - DNA, 2304 bp, Arabidopsis thaliana
atgtggaggctgaagatcggggctaagggcggagatgagactcacttattcaccaccaacaactacaccggaaggcagacttgggagtttgatgccgatgcatgctctccagaggaactcgctgaggtcgatgaagctcgtcagaatttctccataaaccgatcacgtttcaagatcagtgctgatctcctttggcgaatgcagttcctgagggagaagaagttcgagcagaagattccgagagtggagataggagatgcggaaaatataacgtacaaagacgcaaagacggcactgagaagagggatactctatttcaaggcattgcaagctgaggatggacattggcctgctgaaaactctggttgcttgttcttcgaagctccctttgtcatatgcttgtacatcactggacatttggagaaaatcttgactttggaacatcgcaaagaactattgcgttacatgtacaaccatcagaacgaagatggtgggtggggaatacacgtggaaggccaaagcgctatgttctgcacagtcatcaactacatttgcctacggattctgggagtagaagcagatcttgatgatattaaaggaagtggttgtgcaagggctcgtaagtggatcctcgatcacggtggtgctacttatacgcccttgatcggaaaagcttggttatcgattcttggagtgtatgattggtcaggttgcaaaccaataccgcctgaggtgtggatgctccctactttttcgcccttcaacggaggtactctatggatttatttccgggacatttttatgggagtgtcatacttgtatggtaagaaatttgtagctacaccaacacctctcattttacagcttcgggaagagctttatcctcaaccttatgacaaaatcttatggagtcaagctcgcaatcagtgcgcaaaggaagatctctactatccacagtcatttttacaagaaatgttttggaaatgtgttcatatattgtcagagaatatcctgaatcgatggccttgcaacaagcttatcaggcaaaaagctcttcgaaccacaatggaacttcttcattatcaagatgaagccagccgttactttaccggtggatgtgtgcctaagccgtttcatatgcttgcttgttgggtagaagaccccgacggtgattattttaagaaacatcttgctcgagtcccggattacatatggattggggaggatggtctgaaaatccaatcttttggtagccaactgtgggatacagcattctcacttcaagtcatgttagcttatcaagatgttgatgacgatgatgatgagattagatcaacgttaatcaaaggatacagtttcttgaataaatctcagcttacacaaaatcctcctggtgaccatagaaaaatgttgaaagacattgcgaaaggaggatggacattttcggaccaagaccaaggatggcctgtttcggattgtactgctgagagtttagagtgttgccttgtctttggaagcatgccatcggagttgattggcgagaaaatggatgtagagaggctctatgatgccgttaatttacttctctattttcagagcaaaaatggaggtataacagtgtgggaggcagctcgtggaagaacatggttagagtggcttagtccagtggagtttatggaagacacaatcgtcgagcatgagtatgtagaatgtacggggtcagcgatagtggcattggctcggttcttgaaggagtttccggagcacagaagggaagaggttgaaaagtttatcaagaatgctgtcaaatacatagaaagctttcaaatgcccgatggttcgtggtacggaaactggggtgtgtgtttcatgtatggaacctttttcgcggtaaggggtctagtggctgcaggcaagacgtaccagaactgtgagccgattcgtaaagcggttcagttcattctggagacacaaaacgttgaaggcggttggggtgagagttatctctcttgccccaacaagaaatatacacttctagagggaaacagaaccaatgtggtgaatactggacaagcattgatggttcttattatgggtggtcagatggagagagaccctttgcctgttcatcgcgcagctaaagtgttgatcaattctcagttggataatggcgattttccgcaagaggaaataatgggagtgttcaagatgaacgtgatggtccattatgcaacctatagaaacattttcactctttgggcactcacatactacacaaaggcgctgcgcgtgcccctctgttga

SEQ ID NO: 85 - DNA, 2163 bp, Arabidopsis thaliana
atctcattgaggatttttgagttctcaattgtcacaagaaaagatgaaaagattcaactatggctttttccacttggtgcttttcctcatctctcttcttcttcttggttcaggaatttgcatggatcctttctcctacgaccagtctctaaaatcagagtgcctcatggagcctccacaaacaactgccaataccggaggtgaaggagtcaaagaattgaagatcaacgaaaatggtggaatcagaaatgtagtagagggagttgatcttcgggaaggaaacatatacatcacttctgcttgggtgaagttgagaaatgagagtcagagaaaagtaggaatgacttttagtgagaagaatgggagaaacgttttcggaggtgaagttatggcgaaaagaggatgctggtctttgcttaaaggcggtattaccgctgatttctctggccctatcgacattttcttcgagagcgatggcttagcgggtttggagatatcagtacaaaatgtgaggatgcaacggttccacaaaactcaatggaggctacaacaagaccaagttattgaaaagattcggaagaataaagtgagatttcaaatgagttttaagaacaaaagtgcattagaaggatcagtgatttccatagaacagatcaaaccatcattcctccttggttgtgctatgaactaccgtattttggaaagcgatagctatagagaatggtttgtgtcgcggtttagactcacttcattcaccaatgaaatgaaatggtatgcaactgaggcagtgagaggtcaagagaactacaaaatagctgattcaatgatgcagctcgcggaggaaaatgcgattctagttaaaggacatacggtcttgtgggacgataagtattggcagccgaattgggtaaagacgatcacggatcctgaagatttaaagaatgtgacactcaacagaatgaactcggttatgaagagatataaagggagactaataggatgggatgtgatgaatgagaatgtacatttcaactactttgagaacatgcttggtggaaacgcttcagctattgtctactctttggcctctaagttggatcctgatataccgttgttcctaaacgaattcaacacggtagagtatgataaagacagagttgtgagccctgttaacgtggtaaagaagatgcaagagattgtttcattccctggaaacaataatattaaaggagggattggagcacaaggtcactttgctccagttcagcccaacttggcttacatgagatacgcattagatacattaggctctttgagttttccggtttggcttacggaggttgatatgttcaagtgcccggatcaggtaaaatacatggaggatattctgagggaagcttactcacatcctgcggttaaagccataatcctatatggagggcctgaagtgtccggtttcgacaagttaacgcttgccgataaagatttcaaaaacacacaagcaggggatctcattgacaaattactccaagagtggaaacaagaacctgtagagattcctatccaacaccatgaacataatgatgaagaaggaggtcgaataatcgggttttctccggagatttccttactgcatggacattaccgagtgactgtaactaatccatcgatgaagaacttgtccacccgcttcagcgtggaggtaactaaggagtcaggtcatcttcaagaagttcaacttgtaattgatgcttgaaaactgcactatattatgtatcacatattgtgaatcatcccatgagaggttatacaagagattttgaaatcaaattctcaataaattatattcacagagccacagaccaacttaaaatgccggtaacaaactgaagaatgaatttcaatggtgttgttctttcattatctcggctgctagaataacaagctccaccatctcaaatcctgcagcagaaacagaatcggtcctttcacagctcgactcgccatcagtaactgattcaatgtctgattccgccgaccagctaattggtatggagatcccaagggcagtcttcaaatgggttgcctccacaaggatgttggcaatcgctacttcgcaacttcttgcagttgtttcagtatcatttaattcctttacctgaa

SEQ ID NO: 86 - DNA, 564 bp, Arabidopsis thaliana
atgactagaggcatgataccaacaaaagcaaaggtagtagtcatctcactgatttgggctattctggtgttggaaagtgcaacagtgtcaagtgcagtagaagatttggtggtggaacagtgcaagcacaactgtaaacatgatatccacaacaagaagaaagagtgtgaagataagtgcaatgaactgttgatgatggagatagagaaagagacaagtggacgacaagaagaagaacacaatcccttctgtgaggcattttgcaacccctttgaaggactctttcaacattgcatggccgtttgccctcgcaccaagtccaaaccagagatgatggtcataggaggagaaggtgttgctaatgagggtttgcagacaaaatgcaacagaaaatgcctgtcttacaccgaaccggaggcctataaaaaatgcatatccggatgcttcatgtccaacgaggaagtctgtgagacatcgtgcagtattcttcaagaggaaccgctcactataaggtgcatgaggatttgccatgagagaattcccggagttgtagcctctacttaa

SEQ ID NO: 87 - DNA, 601 bp, Arabidopsis thaliana
cacaatcccaattaaacaaacaaaaatgaggaaatccatctcaatagcttttgtcattgcaatcaccattttcatgtcacatcttaatgtttttacagtgtatagtttaacaccgtgtgaagaagcaacaaatcttttaacaccttgtttgaggtacctttgggctccaccagaagctaagccatcaccagaatgttgcagtggcttagataaagtgaataaaggtgttaaaacgtatgatgatcgtcatgatatgtgcatctgtttgtcgagtgaagcagcaatcacttcagccgatcaatacaagtttgataatttacctaaattatgtaatgttgctttattcgcacctgttggtcccaaatttgactgtagcaccattaaagtttaaggtgaagaaaaaaaaaaggtaaagtgaagaagaagtataaatagtctcaatattgtaaggtttcgtttgtttaattttgattaataaaaacagagaagtttattctcaattaaagactttgagttcttgttgttaagatccattaatactcaaaacaaagaaatccgagcaacgggttttgttatgtgaatcaatagatctcggaaaaca

SEQ ID NO: 88 - DNA, 1356 bp, Arabidopsis thaliana
atgccgattcacataggttcatcgatccctttaatggtcgagaagatgctcaccgaaatggtaaaaccctcaaaacatattcctcaacaaactcttaacctttcaacacttgacaatgatccttacaacgaagttatttacaaggcatgttacgttttcaaagccaagaacgttgctgatgatgataaccggcctgaagctttgcttagggaggctttatccgatcttcttgggtattactatccgctttcggggagtttgaagcggcaggaaagtgaccggaagcttcagttgagttgtggcggtgatggaggtggtgtgccgttcacggtagctactgcaaatgtcgagctctcttctttgaagaatctagagaatattgactcggatacggccttgaattttttgcctgtacttcacgtggatattgatggttatcgaccttttgctttgcaggtaaccaaatttgaatgtggaggatttatcttagggatggcaatgtcacatgcaatgtgcgatggatatggagaaggtcatatcatgtgtgccttgacggatttggctggcgggaagaagaagccgatggtgacaccgatttgggaaagagaaagactcgtggggaagccggaagatgatcaacctccatttgttcccggcgacgacacagctgcttcgccttacttaccaacggatgattgggtaactgaaaaaataactattagagccgatagcataagaagattgaaagaagctacattgaaagagtacgacttctctaatgagacaatcacaactttcgaagttataggagcttatttgtggaagtcaagagttaaagctcttaatttggatcgagatggagtcactgttttgggtttatcagtaggaatccgcaacgttgtggatccacctttgcctgatggatactatggcaatgcatatattgatatgtatgtgccattaaccgcaagagaagtggaagagtttacgatctcagatatcgtaaagctcataaaagaagcgaagaggaatgctcacgataaagattatctccaagaagagcttgcaaacactgaaaaaatcattaagatgaacttaacgatcaaaggaaaaaaagatgggttgttttgtttgactgattggaggaatattgggattttcggatcgatggatttcgggtgggatgagccggtgaatatcgtacccgtggttccatcggagacagctaggacggttaatatgttcatgcgaccatctaggctggaatcggatatggtcggaggggttcaaatagtggttacattgccaagaattgcaatggttaagttcaaggaagagatggaagctttagagtaa

SEQ ID NO: 89 - DNA, 1022 bp, Arabidopsis thaliana
attgtcttcaatgaattcctaaaactagaagaagcgttactttagaaaaccaattataaaaatctcctctttcttcatcaaattccacaaagcatcagtttcttctccttctccaagctctcgcatcactttcatcgatttttcctctctgcgtcgatccttcagacatcggcgtcggagtttccgacaggaatctaaaaatgtcacgtggaagaggagttcctatgatggacctgaaacgaagttatgatgttgaagacagggtggtgtccgtgtctataccatcaataatcgaagctgatgaggctgatctgtggccactacctgagattgataccaagaagtcgaaatttccttgctgtatagtttggactcctcttcctgttgtctcttggttggctcctttcattggtcatattggactttgcagagaagatggagtcattttggactttgctggatctaacttcatcaatgttgatgattttgcatttggtcctcctgctcgctatctccaactcgatagaaccaagtgttgcttaccaccaaatatgggtggacatacttgcaagtatggattcaaacacaccgactttggaacagcgcgtacatgggataatgcactgagctcgagcacacgtagctttgagcataaaacctacaacatcttcacttgtaactgccattcgtttgttgcaaactgtttgaaccgtctttgctatggtggctcaatggagtggaatatggtgaatgttgctattttacttatgatcaaagggaaatggatcaatggttcatcagtagtccgctcgtttctgccatgtgctgtggtcacgtctttgggggtggtgcttgtcggctggccattcctcatcggtctctcttcgttctcgctactactctttgcctggttcataattgctacttactgttttaagaacataattacttgaagcagtatgagagaaatataaatatgatgtatcaccaaaattatgttaatcttaagaattgttctcttt

SEQ ID NO: 90 - DNA, 1894 bp, Arabidopsis thaliana
cactataaatactgtttccatacaaaatcatcatgtacacataaaaaaatcaccaaacacaaaaatggtactcttcactttatcaacaacttcttcttcttcttctaagctaaaacaacattcacaccaaagcttctcagagtctctaatggaacacactatcgaagacgctgaatccatcatccatcgatggatttcaccagaacacgtccactcttcttccttctgcttcatctcatcgctattttcaaccgaaaaccgcgaagaagcgaaacgattcatcgacgctgttaccaccttacactccggtatgataagactaatctcagtgaatccaacgtcaatgaaactcgttaaagcagagaatctaatgcgtatctcaatgactcatctctccaaagagttttaccgcattctcaaatcgaaccgacgttatctcgaccccgaatccgtctctatccgttcttcaaaagcttccgattccgactccgattccgattccaacaccatggatgatctaaagatgatcgcggattgtatgatatcatctggctacagcaaagaatgctttaaaatctacaaaagaatccgtaaatcgatcattaacgaagcgttaaaccaactcggattcgagaatttaacgttttcgcagattcagaaacttgaatgggaagttatggagaagaagatacgtaaatggttaagaacaacaacaagagcagtgaatactctgttttccggtgaacaaatcctctccgatcatgtcttctcttcatcatcatcaacaattcgtgaatctgcatttgcagaaatcacatcacaaaccgctttagctttgttcactttcccggaaaaaatggcgaaatgtcgaaaatctccggagaagatcttcctcactctcgatgtttatcaaacgatcgttgatctattacctaagatcaacgaactctttagctctgattcaacctccaccgttagatcacaagtcgatttaacattagtgaatctcagagaaggtgtggtttcgatgatcgacgagttcgaatcttcgatttcgaaagaatcatcgaaatcgttaatctccggtggtggaattcatcaattgacaaggtatgtaatgaatttcatcgtcttcctcgctgattacagtgatacactctccgatatcatctcgaaaccgtcgttaccttcaccggaagaagaaaaagactccggagattcgtcaccggtgaaatcacgaatctcgaggttgattttgttcttactctgtaaaatcgacgccaagtctcgtctctataacgacgtagctctctcgtatctgtttttgattaataacgttaattacgttgttgttaaagtccgatcttcgaatttgaagacggttttgagtgaggattgggttaagaagcatgaagcgaaggtgaagaagtatgtggcgaagtttgaggagattgtttggggagagatgatgacgtcactttctgatgatgtgacgatgactgcggaggaagggattaagcggtttagtgatgggtttgaggaagcgtataagagacaaaccggttggattgtaccggattcgaaattgagagatgagattaaacggtctgttgggatgatgattataccgagatattccgggttttgtgaaaggaaccgggtcaggttattggagaatgtcggatttgaccctgaggatattgggaattatctttcggatttgtattttgggtctggtggatcagggagtggttcgtcagttcattcttcgggttcttctgtttaacacgtttgtgatgatttaatttatattgataagtaaataatattggtatttgatatcttgtcccaaaaatagaaagtaaatatattgatgtaattattttggaagcta

SEQ ID NO: 91 - DNA, 1330 bp, Arabidopsis thaliana
aaaacaaaaaaaaagaggaagcaattactataggggaaaaaaaaatctgaacaaaatgatgaaactcctcttggtggtggcaacttctgttgcccttatctttagcgtcactgatttatccggtgagggaccaaaacatggaggagaatccatgttgacagtccaaatccctgatttccgtctgattcctaccaccggagctttgggaccggagagttttgtctttgattttttcggcgatggtccttacaccggtttatctgacggtcgaattgttaagtggctagctaatgagagccgttggatcgatttcgccgtcaccacctccgcaagagaaggttgtgagggcccgcacgagcaccaacgaacagaacacgtgtgtggacgaccattgggccttgcctttgacaaatccactggtgacctttatatagccgatgcttatatgggccttcttaaagttggcccaacaggtggtgtcgccactcaggtgttaccacgtgagctaaatgaggcccttcgatttaccaattctttggatatcaatccacggaccggagttgtctactttaccgacagtagttcggtttatcaacggaggaactatataggggcgatgatgagtggggacaaaactggtagactgatgaagtacgacaacacgaaacaagtgaccactcttctaagcaacttagcgtttgtaaacggtgtcgctttaagccaaaacggtgattaccttctcgtcgtcgagaccgccatgtgtcgtatcttacgttactggctcaacgaaacgtcggtaaagtctcaatctcacgataactacgagattttcgcggaggggctccctgggtttccagacaacataaagagaagtccacgtggcggattctgggtaggcttgaacacaaaacactcaaagctgacaaagttcgccatgtcgaacgcgtggcttggacgtgccgctttgggcctgccggtggattggatgaaggtccattcggtttgggccaggtacaatgggaacggcatggccgtgaggttgagcgaggatagtggcgttatattagaggtattcgaaggtaaaaatgaaaataagtggatatctataagtgaggttgaagaaaaagatggaactctttgggttggatcggtgaatactcctttcgctggcatgtataaaatctaaaattgagtaatacaaatatgtttttccaacaatatgattcatatatagataattagacgatacatcccccctccccctattcttattttttaggataacaactaataagtccgtttagtaccactttatattgtgctaggtagc

SEQ ID NO: 92 - DNA, 1235 bp, Arabidopsis thaliana
gaactgagacctctttaaaccggcaaaagatccataccgtagcagatcgaagtagaacgaaagatagagaaagcggacacataccagaacagggatggaaaaggtaggtgaagatgaggagaagaccattgaagaagcaaacaactcaactgaggagacgaagagtgataaagaggaggaaaggataaaaggtactattgctgatcaggttgatccagtagattccactgaagaaggttctacgggtccatccaactcacacactgtagtctccaaagatcatgattttagtgaatctgatatggaggacgaagagcaggttctcgagtttttcagacgtaatcacggtttttcacctgaggtcaccaagagaaacaacttcccatatgttaacaactctgaaaggatggtacttcagttccaagaagacacttctgcagaaacagaacaaacaaatgaaatgttccacagtttgaatgatagcaacgagattcttgaaggaaccaagtcatcatcagcttcagatgaggataccgaggactcatctagtaactcagaccttgattccagcctttccaggtattattttgacggatccttaccggtttcagctcatgtcgaagaatttgaaactcatcaagatgaatcccttgtacctaaagatgaaaaccagatgcctctgctgtgtctcaagcaacccatgctgcaaccaacttcatggagaaattgctgtggactcctcgagcttctctgggctgctgatccataaatttcagatacgaggaaaatcgacctccaatgaatggattttagcagtaagtaaggatatagacgtgacatgttgttctagtaaccaacacaaaatggtttatagtagtaagtagctcatattcactttctctttaggatctatgtaatgaaccactgtcaagcaaacttttagaaaaatgtttctctttgtaatttagttaacaggagactacagaccatttgaaaagaaaagcaactacacatctttagcctaaaagcgaggataaccaattaccttaaacaaacaaaaacaaccaaaaacatcacaaagtcgaaaccaaagccaagcaaaatcttgggcacctatatgactgtgaaactgcaaaacgttatggtcttcagctaatcctatgctccatattatcgaatcacattcgttttgaatagcatccgaacaatgtcgctgccactaaccagcagcaacc

SEQ ID NO: 93 - DNA, 2155 bp, Arabidopsis thaliana
ccttccttgaaactgagcttgcataattgatgatatcagcactgattttttttccctttaactgatatattgcaaggacaaagttaatctccatttctgggtatgtaaatatggctaaacccactataaatatacccccttactttgagtcctgaggcagtcattacctctcttcttcttcttcttcttcttcttctttctttgggttagctgagaaatggatgtaatgaagcttgatcacgacagtgtattaaaagagcttgagaggatcacctcgaaagctgctgaagttcaagataacattttacgtgggatcttggaaagaaacaaggacacagagtacttgagtaagtacatgaatggctctaaggatgttctggagtttaaacgcgctgtgccaatcatcatatacaaagatatctatccgtacattcagagaattgctaatggagaagactcatctcttattactggccattctattactgaaatattatgcagctctgggacttctgctggagagccaaagctaatgccaaccattcctgaagatcttgatcgccgcacttttctctacaatcttatcattccaatcgtgaacaagtacataacaggacttgacaaaggaaaagcaatgtacctaaatttcgtaaaggctgaaacatcaactccttgtggtttaccaatcagagctgtcctcactagttactacaaaagcaagcatttccagtgcagaccttatgatccattcaacgacttaaccagtcctatccaaaccatcctttgtgaagacagcaaccaaagcatgtactgtcagttactagccggtctgattcaccgtcacaaggtgatgcgtttaggagcagtctttgcttcagcgtttctccgtgcaatctcttatctcgagaagaaatggagtcagctctgtgaagacatccgcaccggtagtctcaaccccatgatcaccgatccaggttgccaaatggcaatgtcttgtcttttaatgtcgccgaatccagagttagctagcgagatcgaagagatctgtgggcggtcgtcgtggaaagggattctgtgtcagctctggcctaaggcaaagttcatcgaagcagtagtgacgggctcaatggctcaatacatacctgcacttgagttttttagccaggggaagattccattggtttgtccaatgtatgcttcctctgagacttactttggagtcaacgtggaaccactctccaaaccatctgacgtcgttttcactctcttgcctaacatgtgctacttcgagtttatccctctcggcaaaaacgggacactctcttttgatctagacgacgatgaacaagtcccctgtgataaagtcgttgacttggtcaatgtcaaactcggccgctactatgaactggtcgtcacaactttcgcaggattgtaccgttaccgaatcggcgacgttcttcaagtggcgggtttctacaacggagcaccacagttccggtttatctgcaggagaaacgtggttctaagcatcgacttagacaaaaccaacgaagaagatctacacaggagcataacgttagccaagaagaagcttggaagcaacgcattcctggcggagtacacgagctacgcggacacgtcatcagtgccaggtcactacgtgctattctgggagatccaaggtcatctcgagccgaaactgatggaagagtgttgcgttgcggtggaggaagagctggactacatatacagacagtgcaggacgaaagagagatcgataggggcattagagatcagagtggtgaaaccaggaacgttcgagaaactgatggatctgattataagccaaggagggtcgtttaatcagtataaaacgccgagatgtgtcaagtccaacagtgcaacgttcaagctcttgaacggacacgtaatggcttctttctttagccctcgtgacccgacttgggttccatgatcccaagacttttaatcatcattaccaaatttttacactctctgtaataataaccatccgatcgaattcgctgctttttttttttttttttttttttcgctgctttattgataaaacatatttataagaaattttatcgacttaagacggacgtcgttgcttcaccgctacggcgttacc

SEQ ID NO: 94 - DNA, 1091 bp, Arabidopsis thaliana
atggtgcttctacttgtgattgtgggattaataagctattatgtctacaagtccataacaccgccgccaccgattccactgccggaaaatgtttccgagatatctccaagaatcaagctcaatgatggaaggcatttagcgtacaaggaattagggtttccaaaggacaaagccaaaaacaaaataataatcgtccacggaaatggaaattccaaagacgtcgatttatacatcacacaggaaatgattgatgaattcaagatatactttttgttcttcgatagagctggttatggagaaagcgatcctaatccaacacgaacgctgaaaacagatacatacgatatcgaagaacttgctgacaaattgcaagtcggtccaaagttccacgttataggcatgtcacttggagcttaccctgtttacggttgcctcaaatacattcctaataggctcagtggagcttcgttggttgttccgttagtgaatttttggtggagccgtgtgcctcaaaacttattgaatgcagcgatgaagaaattgccaattggatttcaattgacacttcgagtcgcacactactctccatggttgttatattggtggatgactcagaaatggttcccgaatagtcgaaatcccaaagatactatgaccgagcgcgacctagaactcgcggaaaagcataccaaacactcttatatcaaggagtctgctttacgacaaggtggatatgtgaccacacaacaagacatcatagcgggttacgggaattgggaatttgatccaaccgaattgaagaatccgttttcggatagtaacaaagggtcggttcatatgtggtgtgcactcgaagacaaacaaatttcacgcgatgttttactctatatatgcgataaactgccatggataaagctccatgaggtccctgatggtggacattatattatccatgagaagcggcattttgaagccattatcaaagccgcttgtagtgactagtggaagatacattataacaaaaaaaaactctaaaagatttgtatctaaaatcagtttaagaaaaattatggctatgtaagtttcatgtg

SEQ ID NO: 95 - DNA, 841 bp, Arabidopsis thaliana
ctcaagtttttttattagaaaaaaatatatgatggaagtgcttcttcgcttgcttgtaactcaagttatcttattggctttagcaacttcatttgtatcttgttacgatccaaatcctcttcaagacttttgtgttgccgccagcgaaactaatagagttttcgtgaatggcaaattctgtaaagatccaaaatcagtaacggccaatgatttctcttattcgggactcaacatcgcccgaaacaccaccaacttcctcggttctaatgtcacaaccgtagatgtcaacaaaatccctggcctcaacaccctcggagtctccctcgctcgcttagactttgctcagggaggtcaaaacccaccgcacatacatccacgcgccactgaaatactcgtagtcaccaaaggaaaactcctggttgggtttgtgtcttcgaaccaagacaacaatagactgttctacaaggttcttaaacgaggagacgtttttgtgtttcccattggtttgatacattttcaaatgaacgttcggaggacaagggcggtcgcgtttgctgggtttgggagccagaatcctggtaccattaggattgcagacgcggtttttggatcgaacccttcgattcctcaagaggtgttggctaaagcttttcaattagacgttaaattggttagatttctccacatagtgtttggtccgccattatggtagtaagttttaagattgatgataaaatttgtgagttaatcacatgatatacatacatgtatttaaatcccaaacttataaatttgtattttttatttgttttctaaatgaatgtaaaattagttcaaccct

SEQ ID NO: 96 - DNA, 709 bp, Arabidopsis thaliana
tcaatttttcaatctttcatcaaaatttcttccagagaaaaaaaaatctcccccacaaagaaaacaacaatgtcgacaaaaaagatcatgttgaagagctcagatggtaaaatgtttgagattgaagaagagaccgcacgccaatgccagaccatagctcatatgattgaagccgaatgtacggataacgtaatcccggtttcaaacgtgacaagcgagattcttgagatggtgatcgagtactgcaacaagcaccacgtcgatgccgctaatccttgctccgatgaggatctcaagaagtgggacaaggagttcatggaaaaagatcaatacacgatctttcatctcatgaatgctgcgtatgacctacacatcaaaagccttcttgctctagcttaccaaacagtcgcggatatggtcaacgacaataaatgggcttttgaatgagcggattatcaaaacctaagaagcttttcttgcttttcttttctctcttttagtgtgtgttattcagtttcgttatcaatgtagatgatggtgacttcgtctacgttcgacaatctaataatgaaagaagctttctttctgttcttttttctttttctttcttcgttagtgtgtgtttttcaatttcttgatcaatgtagttgatgatgacttcatcaaagttcaataatcaaataatgaaagtagacatatatttcgttta

SEQ ID NO: 97 - DNA, 1656 bp, Arabidopsis thaliana
aacaaaacaacaagaaaaaatggcaataaccaacaaattaatcataacacttcttctccttatctccatagctgtcgtccactgcttatccttccgtgtggagatcgacgagttcgagccaccacagcaaggagaacaagaaggtccccgtcgccgtcctggtggtggctctggcgagggatgggaggaagagtcgacgaatcatccataccacttcaggaagcggagtttcagtgattggttccagtcaaaggaaggttttgtgagagtgctgcctaagttcacaaaacatgcaccggctctcttccgaggaatcgagaactacagattctcgttggtggagatggagccaacaactttctttgtgcctcaccatttggatgccgatgctgtttttatagtcctacaaggtaaaggagtgatcgagtttgtgacggataaaacaaaagaatcgttccacataactaaaggtgatgtggtaagaatcccttctggtgtcaccaactttatcaccaacactaaccagacggttcctctccgcctcgcccagatcaccgtccctgtcaacaatcccggcaactacaaggattacttccctgctgcatcccaatttcagcaatcctacttcaatgggtttaccaaagaagtcctctctaccagtttcaacgtgccggaagaattgctagggagattggttacgagatcaaaagaaattggtcaagggattatccgaagaatttctccagaccaaatcaaggaacttgctgagcacgctacatctccttcaaacaaacacaaagccaaaaaagaaaaggaggaagacaaagacctaagaacgttgtggactcctttcaatctctttgcaatagatccaatctactccaacgactttggtcatttccacgaggcacatcctaagaattataatcaactgcaagaccttcacatagccgccgcttgggctaacatgacacagggatccttgttccttcctcattttaactctaagaccacatttgtaacgtttgtggagaatggttgtgcccgcttcgagatggctactccttataaattccaaagagggcaacaacaatggccaggacaaggacaagaagaagaagaagatatgagtgaaaacgtacacaaagttgtgtcacgagtgtgtaaaggcgaagtttttatcgttccggcaggtcatccattcactatactctcgcaagatcaagactttatcgcggtagggtttggtatttatgcgaccaacagcaaaagaacgttccttgcaggggaagagaatttgctgagcaacctcaacccggcggcaactagggtaacctttggtgttggaagtaaagtcgcggagaaactgttcacgagccaaaactattcctactttgcacctacgagtcgtagccaacaacaaattccagagaaacacaagccatcgtttcaatcaatcttagactttgctggtttttgaaaatgcttttttacagtcctaagaaaggaaagagtttaagagtttaatataatctttgtgaagatatgcaataaaatatggtaacgctctgcatgtaacttctatgtactggtttcttgagttgtaaatttttatgtgacagttttaataaaaccaacggtttagttataacccat

SEQ ID NO: 98 - DNA, 1059 bp, Arabidopsis thaliana
atggggaaaaccgacggaagctcatggttcacggccgttaagaatgttttccgatcgccggagaagttaatccctagaagaataaatcgtcgacaagacaacgacctcgtcgaagaagtagaggacgaactacaccaacgaccgaagagaagaaaaagaagatggctatttaagaaagtttcttctgatccttgtgcaataaacgtaggaataaacacaacttccacggctattaacgcgattgccgcggaggaaacagagaaaactgtttcgccggcggccaaagaaaccgtatttttctgtcgaacgtctgtctacctaaagagacacgtggctgctattctcattcagacagctttccgaggatgcctggcaagaacagcggttagggctctaaaaggagttgtgaaactacaagccctagtgagaggccataacgttcgtagaagaactagcattactttgcaacgggtccaggctttggttcggattcaggctctagctctagatcaccggaaaaaactcacgaccaagctcggggacgaaatttcctactctcatgctttctctaaacagatgtggagaacaatggaaagagaagctcatagtgaaagtgaattagaggacaaaagaccgagtagattaaacgggtacggttatcaagaaaccggaaggagaatgtcaaccgatcaggctatcgttgaaccggtcaagatagtcgagatcgataagtataataatacgtactcacaccaccaacaactcaacgaccagacgccacgtggcaattctttcgtcacacggcaagcccattcaattccaaattacatgtctaccactgcctcaaccgtggctaggttccgccgaccacaaagcgtaccaaaacagagatcaaaccggacctgtttagataacaacgaaccaagattaagattggttagaaagcgattgtcatttcacaatgataatccgcaatcgtacggttatattgccggtgatggttacttttggtacgacatcgacaagagaacgaatgctcacgaagattttcagtactaa

SEQ ID NO: 99 - DNA, 1606 bp, Arabidopsis thaliana
atgggttcatgcagtcctcaactaccactcatctgtctctcggaccaaaccctaaaaccaggaagctcaaaatgggttaaagtgaggagtgatgtccgtaaagctttagaagactacggttgtttcgaagccaaaattgatcaagtgtcaatggagcttcaggggtcggttttgaaggccatgcaagagctttttgcgttaccgacagaggccaaacaaagaaatgtgtgcccgaaacctttcactggatatttgtctcataatggtctctccgagagttttgggatcaaggatgctaatattttggagaaagctcacgaatttactcaacaactatggcctgagggtaacaagagtatcagatgatccaactgtatgctgagaaattagcagaactggatatgatggtgagaagattaatactggagagctatgggatagaatacttcattgatgaacatttgaactcaacgtattaccgtatgcgattgatgaagtatatagcacggcctgataatgatataactgctgctgttggtgctaatgtggataatggtgctaacgataatgccgatggtgatgctaatgtcaacgatgatggtgctagtattggtgttaaagttaatgtcgatgttggtgatgatgttaatgacaatgatagtgttaatattggtgttggtgttgatattaacgttgagaccaatgttaatggtgatcttgatgctgaagctaatggtgatgctactgcttgggtcgttggtgctgttagtgggaatgctagcgttggtgccaaagaagctaatgttgatgcggagttgggcttacctagtcatactgataaaagccttactggaataatttatcagcatcaaattgatggtttggaggtgaagaccaaagaggggaagtggatcagagttaaaccagctcctaataccgtcattgttattgcgggagatgctctatgtgcacttatgaatggtagaatcccttcaccgtatcaccgagtaagggtaacagagaaaaagaagacgagatacgcagcagcattgttttcgaatccaaaagaaggttatatcatagattcaccaaaagaacttgtggacgagaagcatccacgtgccttcaaaccctttgattttgtcgacctttttaacttctatcacacagaagctggtcgtagagctccatctactctccaagctttttgtggcgtctctgctgggaaataaaggtgtgcgcttcaaaatgtttggacgtggtttcaagtttcaactagtatcaacaactatcttacgaaataaggtgtttatgttgtgtaataaacatttaggtatatgtttgaattttgtctttgtatataggtaacaacactttgattacttcttttgtttcatgacgttaattcagccacaaaccggataacctgacctcagtgtaagagattgtcttttcttgttcctagaaacatgtggcctaaaccagaagcgcatattgatatagttaatagttctggaacaataaaagacattttcctagcatgtaaaagtgtagcatgatgtctttgtttcagccacaaacttagcaactaatatagttggtattt

SEQ ID NO: 100 - DNA, 1470 bp, Arabidopsis thaliana
atctgtctctcggaccaaaccctaaaaccaggaagctcaaaatgggttaaagtgaggagtgatgtccgtaaagctttagaagactacggttgtttcgaagccaaaattgatcaagtgtcaatggagcttcaggggtcggttttgaaggccatgcaagagctttttgcgttaccgacagaggccaaacaaagaaatgtgtgcccgaaacctttcactggatatttgtctcataatggtctctccgagagttttgggatcaaggatgctaatattttggagaaagctcacgaatttactcaacaactatggcctgagggtaacaagagtatcagtaagatgatccaactgtatgctgagaaattagcagaactggatatgatggtgagaagattaatactggagagctatgggatagaatacttcattgatgaacatttgaactcaacgtattaccgtatgcgattgatgaagtatatagcacggcctgataatgatataactgctgctgttggtgctaatgtggataatggtgctaacgataatgccgatggtgatgctaatgtcaacgatgatggtgctagtattggtgttaaagttaatgtcgatgttggtgatgatgttaatgacaatgatagtgttaatattggtgttggtgttgatattaacgttgagaccaatgttaatggtgatcttgatgctgaagctaatggtgatgctactgcttgggtcgttggtgctgttagtgggaatgctagcgttggtgccaaagaagctaatgttgatgcggagttgggcttacctagtcatactgataaaagccttactggaataatttatcagcatcaaattgatggtttggaggtgaagaccaaagaggggaagtggatcagagttaaaccagctcctaataccgtcattgttattgcgggagatgctctatgtgcacttatgaatggtagaatcccttcaccgtatcaccgagtaagggtaacagagaaaaagaagacgagatacgcagcagcattgttttcgaatccaaaagaaggttatatcatagattcaccaaaagaacttgtggacgagaagcatccacgtgccttcaaaccctttgattttgtcgacctttttaacttctatcacacagaagctggtcgtagagctccatctactctccaagctttttgtggcgtctctgctgggaaataaaggtgtgcgcttcaaaatgtttggacgtggtttcaagtttcaactagtatcaacaactatcttacgaaataaggtgtttatgttgtgtaataaacatttaggtatatgtttgaattttgtctttgtatataggtaacaacactttgattacttcttttgtttcatgacgttaattcagccacaaaccggataacctgacctcagtgtaagagattgtcttttcttgttcctagaaacatgtggcctaaaccagaagcgcatatt

SEQ ID NO: 101 - DNA, 2367 bp, Arabidopsis thaliana
ggagaatcacagctgccttcagaaagatacgacgtcggcggccaaattagacgtcgaaactggaaacctccggcagagagatgaaacgaagccgttttatgcaaactcactgacgccacgtgagatggaatctcttgttgcgatctgcgataccttcatatcctccatcgacgactctggagtaggacacgtggatgattgcgtcgctggatatttctccgcctccgcttctcagaccggaactcccgaccgcgtggcgaggttaatgagtgagagacttcaccacccaaagaagtggatactaagagctggattgtggttactctctacttggatcggaagtctagtcttgtgtggttggagaagtttcaccggcgagtttccttacttccggagattctgccggcttccggagaaacggagagaagagatattgctgaattggtcttcaagctatttctcacttcttagaatgttatttaggaccatcaaacttataagtgcccttgtcttcttcactcaggttgatgaaaaaggaaggaacttggcgtggaaagcaataggttacaatggacccagccctgatcatagtgatcatgaagtagaactaaacgaggagaagaagaagaagaaacctgaggagatctttggaccactttacaatggcatcgttgatctaaaaagccctagagaagccgtggaaaagaagctagccggtcgtgggttcgcagtttcaaatcaaaagaggaatacaaacggatcatctatctctgacccggtgatgaaaatccagtgtgatgctgtggtggttgggtctggatccggtggaggagtggcggcaggagtgttagccaaggctggttacaaagtgttggtgattgagtcagggaattactatgcaagaagcaaactttctttacttgaagggcaagctatggatgacatgtatttatccggtgggttattagcgacgtccgatacgaacgtagtgattcttgcgggatccacagtcggaggtggttctacaatcaattggtccgcctcgatcaagacaccagaacatgtgatgaaggaatgggcagaaaagtcaaaactcgaaatgttcggaagtgatttgtatcgagaggcaatggatgttgtctgtaagaggatgggtgttcaatgcggatttgtagaagaagggtttaataatgaggtattgagaaaaggttgtgaaaagttagggttaccagtgaagaatattccgaggaatgctccatccgatcattactgtgggttttgttgcttgggttgcaagaaaggtcaaaagcaggggacttcagagacttggcttgtagatttggtggaatctgataatggtttaatccttccaggttgtcaagcgacggaagtcatgtacgactgtgaacaggggaagaagaagaaggcaactggagttgcgtttgcgtttggggaagagatttatgtggtggagtctagagtgacaatagtggcttgcggtgcgcttagaacgccgcatctgttgaaacgtagcggtttgaagaatagtaacattgggagaaacctttgtctacatccggttgttatggcttggggatggtttccagaggaagataagtggccggaaaagaagaaaaagagctacgaggggggaataatgactgcgatgtctagcgttgtaattgaagaaacgcatagttcttatggtgaaatggttatccagacacctgctctacatccaggaatgttctcagggatcattccctggacatcaagcaaggatttcaaaacccgaatgctcaaattttcaagaaccgcacacatttttgcgcttctgagagataaaggaaccggaacaatagattccaagacctacattgactacaacttaaacgatgaagacgaagagagtctaaagaacggtcttgaaagagtcttgaagattctggccgcagccggagccgaggagattgggacgcatcattcagaaggtaggagtctgaatgttagaacagcgagttcgttagagattgagcggtttgtgagagaagagagttcaaagccgttgaaggatttgtcaggtcagatatgttcagctcaccaaatgggaagttgtaggatgggaattaggccggaggaatccgcggtgaggccaacaggagagacttgggaggtcgaaaggttatttgtggcggacacaagtgtttttccgaccgctttaggggttaatccgatggtcaccgttcagtctattgcttattgtattggacttaatgttgttgatgttcttaagaagaagaagtgagggttcatcagtttgaaatagattttagttttccacatattttttaaaatgaaatgtttttt

SEQ ID NO: 102 - DNA, 1246 bp, Arabidopsis thaliana
aacttgtcttctctctttccttaactttgatggcactgtcccttctctcctacaacgtctccgacctctgtctcggcaaacctcctcttcgttgtctttcctcctcttcctcctccgtatccgacgccatcgctgccctcaaatcctctgaagacactttcctctccgtctggaattgcaatcacgacgatgacaataacacagagtgcgagtgcttggggaaaatatcaatggctgacgtcatctgccacttgtccaaagaccatgaccacagtctctgtgccttaaactcatccgtctctgttcttctccccaaaactcgttccattgtcctccatgttcaaccatcctgcagcttaatagaagccattgatctgataatcaaaggagcacagaatctgattgtcccgatacatacaaagccctacactaagaaaaagcagcacaacgacaacgtttcggtcaccaccaccacccactcgaacggacaacgattctgctggatcacacaagaagacatcattcagtttctcctcggattcatcgccgcattctctcctttgccagcgatgtccctctctgatctcggtgtcatcaacagcacacacacagttgttgcggtcgattaccactcctcagcgtccgcagttgtctctgccgtatccaacgctcttgccgtccaaacctctgtcgcagtggtcgacggtgagggagatgacccttttacgtctttgatcggcgaaatatccccgatgacattaacttgctgcgacgagacagcagctgcggcggtggcgacgctctccgctggagatctgatggcgtacatagacggagcaaatcctccggagagtcttgttcagatcgttaggaaccgtttggaggataaaggattgattggtttgatgtcgcttttcgattctctctcatcttattcgacgtcgtcgggttattcgtcggaggaagaagctccagtgagaacgacgtcgtatggacggtcgatgagtagctcagcaagaatggcaaggaagtcggaggcgatagtgtgtaatccaaagagctcgttaatggcagtgatgatccaagcggttgctcatcgagtgaactacgcgtgggtggttgagaaggatggttgtttcgttggcatggttacttttgttgatatcttaaaagtttttaggaaatttttggagaatgacatgtgaaaagttttttaaatatattttcttgtgttttgtcgattact

SEQ ID NO: 103 - DNA, 1059 bp, Arabidopsis thaliana
catacaagtatctcggtggcaagagcagggagaggaagagagaagatggaagagaattgcgaggattgcatgaaatgggaagaagaactctactggactcattttcaaactctccatttcactcagctcctccttcctggtttccacaatcgcctcgtcatacctcgaaagttttcaacacactgcaaaaggaagctgcctcagattgtgactctcaaaagtccaagtggcgttacatataatgtgggagtagaggaagatgatgaaaagacaatggcttttcgttttgggtgggacaagtttgtgaaagatcattcgctagaggagaatgatctattggtcttcaagttccatggagtgtctgagtttgaagtgcttgttttcgatggacagactttatgtgagaaacctacttcttatttcgtcaggaaatgtgggcatgcagagaagactaaagcatctcacaccggttatgagcaagaagaacatattaactctgacattgatacagcatctgcccagcttcctgttatatctccaactagtacagtacgagtcagtgaagggaagtatccccttagcggttttaagaagatgcgaagagaattaagtaatgacaatctcgatcaaaaagctgacgtggagatgatttcagctggaagcaataagaaagccttatctctggccaagagagccatttcgccggatggtttcttggtgttcatgaaacgctctcatgtggtatcaaagtgttttctgacaatcccatacaaatggtgcgtgaagaacatgcttatcacacgtcaagaagtggtgatgcaggtggatcaaacgaaatgggagatgaagtttaacattttcggagctcgtggtagtggtgggatttcaaccgggtggaagaaatttgtacaagacaacaacttgcgcgaaggtgatgtctgtgtgtttgagccagccaattctgaaacaaaaccgcttcatctcaatgtctatatattccgtggtgaagaaacggaaagaaccaacaatgttgacccggtttacacaataagtgaataa

SEQ ID NO: 104 - DNA, 1362 bp, Arabidopsis thaliana
atgactaaacgcagcgtttcaaggaatctagttacttgcttagcctcccctaagttctccttgaacgtcttgtgtcttgtcgtcacagtttttgttcttcttcaaatctggtcatttcacattacccaacaacccattttacttcctccttcactattcacatatctaaaagaacaacaacaagaacctgaacaaataaaatctgagaacgagacggcttacttggtggagaaactacgtgagtcggtaacattccttcccctgaaagaccttcgtttttcaaacaaaccacttgaaggtcatacttggtttatgagctctctctacgataaccaaacaaaaggtgaggttcaatatcaagaatttccttcggaatcttcgaaaggaaggcttttgtgcttgaaaggggttgatgagcatgatggatcatatggaactacttatgcactggcttggcctcaagctcttcctgtcaatgccagtctccaggagggattgacatttgtctcgtataatcattacgattacggtaatatgtggcatggactgtccgccatggtcccatttgttgcttggagcttaagacaccagtgcgaaaatcctcaaagatgggttttataccattggggagaactcaggttcaagatggggaattggttgaacgagataatcacagcgacttacggtcagaacacagaatttttacggtttcgtgataagaacaggccgggagagaagaatggaagtcttgatctcattagatgcaaagccagacactattgtaacataagcttgtccgagacatcaaaatcacgaataggtatgacattgctaatgagaaccggaccaagatcattcaagaatgagtcagccgtgatcgatatctttaagagagagtgtaaaaatgtagaagggtgtgaattgaaagtttcttattcaaataatctaacattctgtgagcaagtggagctgatgagaatgaccgatgtgttagtatcaccacacggtgcacaacttactaatttggttctaatggacagaaatagtagcgtgatggaatttctccctaaaggatggcgtaagcttgcaggagttggtcagcttgtgtaccaatggggaactaggtggtcaggaatgagacatgaaggctcgtggcatgacccggatggggaaatatgtcagtttcccgatactgataggcgatgtatgtcgtccgtctataagaacggtaggatcggatacaatgagacttattttggcgagtgggcaaaaagtgttttgggtaagtttaaagaaagaaagatggcaaatgttgtaggacgcaaacacagttatggttcgctagatggatgttggtgttga

SEQ ID NO: 105 - DNA, 1898 bp, Arabidopsis thaliana
agtcactcataactagcagaagttttttctctacagattcatcgtttgaggagttctgtgagtttatcaaggtaggtcagatatgtatcatcatcttcaaacgaggatttttctccaccaacaaaatgatttgctgagagcagaaaacagagctaggattcatgctatgacctctccatcaatctgcagatcttgtgaggagcccatcatttcaaccgaagagagggagctatggttggagaatgctcgtcttcggtccgagattgatacattgacttgtttcatatggagattaaattcgttcaggaacctatatcccgcatttgctacgtctttgactgaagtgggttacggagtggcggttatgacgtcactttcgctgaaagaagttgtttttcttgcgaggcaaagaactccgatgtggacaagtaacgggagattgaatctcgacgaatactactctaaattatttccttggtacgcaagaaacgcacccgggtttgtacatgaggtatcaagagcttctgcttttgtcccatgtgatgcttcatcgctcgtggcaaatcttatgaatcatgtaagttggcaaaaaatctttccgtcaatcatcgcggatgtgtctgtggaatcacaacaacggggattgcaaaagattaatgtgaattttatgccacaaatctctcctctcattcaaactcggaatgtgaaacttcttcgacgctcgaggcatatagaggatgatacatgggctattgcagaaatttctatgtatttcagctcatatgcgcaacatttacgtcctgaatatatgagatttccttctggatatcttatccaacatatagccaatggtatctctaaggtaaccattctcgaccattgggtttacaaggaagaagaaggcatgaacactttcaattcaaactctgaatttggtgcacagagatggctcactgctctccaaaagcattactacaacacctgccccgtttctattccttcaattggtcacaatattcaaatattcgaccagatctgtcgcaagaacttgcttaacctatcttcatttatggttaacgtattttgttcgggagtttgcgggataactggacaaaggtggaatcggttgaatacagttggagtttcggctaataacattagaatgttcacgcaagaaagtcgaggcatgagtgggatcccttgcgttttggttagcgctaccggtttagctagaatgcacactaaaccagaagtaatgtttggattaatcaacggtgcagaaaaacaagaaatatggagttatttagagtctgctaaagatatgaaagaactaattcgtatcggaagacatcctaattcatggaatgaagtctctgttttcagcattgagtggaagggttcgaaggagtggtatctgattcaagaaacatactacgatgaatcaggagcaatgataatccacacttgcgtagaagcgccatattttgcagctgcaataaacggtggggatttgtctggcgtcgaactgttacccagtggattcaccataataccatgcgaatcacaagaatgtttcgtgacagctagttgttatgttaaggctgaccaaactatggtcacgagtccaaatgagctggggagttatatggagaacatggtcactaacattctaggaaatgtccaaaatgctcttccagtccaccgttgaagttttatggcttatgaagtttttaccgttcttgttgtcgtcgtcgtcgttattgctattgctgcatgttgttgttgttgttgttgttgtcgttgtcgttgtatgagagtttgaatttggaactttatttctatgaactttattatacacctatcattaagaaataacaaataaatggtgattatggttt

SEQ ID NO: 106 - DNA, 1262 bp, Arabidopsis thaliana
atgcatgatagtgaaatattcaagtttaaagacatgatgatgatgtcttgcacagttcaaacattagtacttgttccatggtttctagtagtatttgtactcgccggtggagaagactcatccgagacgacggcaatgtttccggcgatgtttgtgttcggagactctttggtggataacggaaacaataaccacttgaactcactggctaggtccaactatctcccttacggcatcgatttcgctggaaatcaaccaaccggtcgcttctctaacggcaaaactatcgtcgatttcattggagagttgctagggctgccggagataccggcgtttatggacacggttgacggaggagtggatattctccatggtgtgaactatgcctcagctgccggaggaatcttagaggaaaccggtcgccatctgggagagagatttagcatgggaagacaagtggagaacttcgagaagacattaatggagataagtaggagcatgaggaaagagtcagtgaaggaatatatggcaaagtcattggtggtggtgtcattgggtaacaatgactacattaacaattatctgaaaccaaggctattcctctcaagctctatttacgaccctacttctttcgccgacctccttctctccaacttcaccactcatctccttgaattgtatggaaaggggtttaggaaatttgtaatagccggtgtgggtccattgggttgcataccagaccaactagccgcccaagcggctctgccaggtgaatgtgtcgaggctgtaaacgagatggctgaacttttcaacaaccgtcttgtatcgctggtggatcgtctcaattccgataacaaaaccgctagtgaagccatctttgtttacggtaatacctatggagccgccgtggatattctcaccaacccatttaattacggattcgaagtgacggatagagggtgttgtggagtagggagaaatagaggagaaataacgtgtctgccattagcggtaccatgcgctttcagagaccgacatgtgttctgggatgcatttcatccaacacaagcttttaatctcataattgctctcagagcctttaatggttccaaatccgattgttaccccattaatctttctcaactttctcgtctctaaaccctcaacaaatccttctctttttgtttatgtatttttgttactttaattttgtagacttgtagtagtactattgcatatttcttcgcattatctttttggtt

SEQ ID NO: 107 - DNA, 717 bp, Arabidopsis thaliana
gtctatctttttcactaacaaagaacaaaaatgggtctggtaacaaaagctctcaaatatctcttactcctttctatttccttgactttcatctacaccaatgcagtttcatccgcttctccaatgactccaccgtcatcgccggctaagatgagcaggagacttgtggcagttgaaggcatggtttattgcaagtcatgcaagtattccggcgtcgatactctcttggaagcatctcctcttcaaggagcgaccgtaaagcttgcatgcaacaacacaaagagaggtgtgacaatggagacaaaaacagacaaaaacggatacttcttcatgctagccccaaaaaaactcaccacctacgctttccacacgtgccgggcttggcctacgaatcctggacccacgactgcaacgatgacatgcaccgtgccgtcaaagctcaacaatggaataaccggtgctatgcttaagccttctaagacaatcaacatcggtgaacacgactacgttctcttctctgttggtcccttcgcgtttgagcctgcctgtgctctttgaagactatactttcgttttatgtatttggtgtgtgcttgattgttataatgatgatcactagtgattttaatgttctgtcttgtttgttttcttggtacgtttccatttgaaatttgtgtgttttgacattataagatcgttagtgtgcatgtttgtagt

SEQ ID NO: 108 - DNA, 2458 bp, Arabidopsis thaliana
aaagactgcttcttttttttttcctccttggtagaaaaaagttctgaaatttgcacattcttgtctctttttttctccacaccgaaatcttctccctatttctccgacgtccttcttcttccttctccggtcaacaccgaccggttctccacggagactctcgtctcccatttttttttttgtacggctactttgatcgatcgccattgctgaatttcaaagccttctctgtgtcattttttctgtaactggaagtgtgagcttccatcaattgagagttgaaagttgactcttaattaaaacctgagagagagagagagattcttcttttatttaatagagcaagatctgggttttagtcagattattaagtcgagatcatcgtgggctactttaaaactaaaaatctgggtttttcgaggtgtgattaatgctcacagatttgtgtggagattacattttctctgagtgttattagagaggataattaaaagcttgagcaccaaacctattatattgtttcattcctgtccttttaaatctgcagtcttttaagctgtggttagtttttccaggcttaccctttaagtgttcgatgaaattcctctgaggggttttgggaactgtgagaatcttctgtgagagtggggttggtgggtgatatagaaaaatgtgtaaaatggagaagtttctttaccacaggaaactatgggagatgaatgttaagcttttaggagagagcaaagttgagaaactcaagaactcttttgtttcgaggcctcgtatgagcttatggatgattcgtgctgttactgtattgttgctttggagctgttttgttcatttgatggctttgggagagatgtggggaccaagattgtttaaaggttggccttcttgtttcaatcaccatcaactgtccactgccgcagagatgacgtctcttcctaccaaaattgctcttccacctaaaagggtatatgtgaacaatggttatcttatggtttcctgcaatggaggactcaatcaaatgcgagcagctatatgtgatatggtaaccgttgcaagatacatgaatgttacacttattgtgccggagcttgacaagacctctttttggaacgatccaagtgagtttaaagacatattcgatgtggatcacttcataagttcgttaagagatgaagttcggatactcaaagagttacctccaaggcttaagaaaagggttgagcttggagtgtaccacgaaatgcctcctattagttggtcaaacatgtcttactaccaaaatcagattcttccactggtgaaaaaacataaggttttacatctgaacagaacggatacccgacttgctaataatggactgcctgtggaggttcagaagctgaggtgccgagtaaatttcaatgggcttaagtttactcctcagattgaggaattaggtagacgagtagtcaagattctgagagagaaaggtccctttcttgtcctgcatctcagatatgagatggatatgttagcattttctggttgttcacatggttgcaaccccgaggaagaagaagaactaacaagaatgagatatgcttatccatggtggaaagagaaagtcataaactctgagctgaagaggaaagatggcctttgccctttaactcctgaggaaaccgctctcactctgaccgcgttgggtattgaccgaaatgttcaaatttacatagctgctggagaaatctatggtggtcaaaggcggatgaaggctttaacagacgcttttccaaatgtggtccggaaagaaaccctactcgaatcctctgatctggatttttgccggaaccattcatctcaaatggctgcacttgattacctagtggcacttgagagcgacatatttgttccaaccaatgatgggaacatggcaagagttgttgaaggtcatcgcagattcttggggttcaagaagacaatccagctgaataggaggttcctagttaagctgatagatgagtatactgaaggattgttgagttgggatgtattttcatccacggtgaaggcatttcactctactcgaatgggaagccctaagagacggttagtgattcccaatagacccaaggaagaagactacttctacgccaacccacaagaatgtctgcagctgttagatgaaccattgagagtcatttgagaatgtgactccaccactggcgagagaacagcttgaaagaggaatttacagtgagttttacagattgaagttatttagtgttcttggtgtagagatttctgaaagagcttccatggatggagattagaatgttgattaaagcttacactgtaaagtttggcatccatggccttgccagttttgttagctaaataataagtgccattttgtgtaattaaaccttggttacagatatatatttttcatattatttttttctct

SEQ ID NO: 109 - DNA, 1376 bp, Arabidopsis thaliana
caaaaacatctgtcgcggagagagagagaaagagagaaagagaaaaatgtcgatggctttgcttttgacatcgccggctatgaagcagaagccggcggtgataacttctcctcgccgtggttcttctccttctcgtcgtcttcgagtttcttgtgttaccacaaaccctgctaggaagaaaaacgaaacatgcaatcattttcgacctatcaaagaagtaaataaccaattaacacacacaataccacaggagaagcttgagatcttcaaatcaatggaaaattgggcagaacaaaaactactaccttatctcaaaccggtagaagattcatggcaaccacaagacttcttacctgcgccagagaacgacgacgaattctacgaccgagtaaaagagatcagagaaagaacaaaagagatacctgacgattactttgtagttcttgtgggagatatgatcacagaagaagcacttccaacgtatcaaacgacgttaaacacactagacggtgttaaggatgaaaccggtgggagtttatcgccgtgggctgtgtggattagagcctggacggcggaggaaaaccgtcacggtgacttactcaacaagtatctttatctaactggtcgtgttgatatgcgacatgttgagaagactatacaatatcttattggttctggtatggattcgaaatttgagaacaatccatacaatggattcatctacacatcattccaagagcgagcaacattcatctctcacggcaacacggctaggctagccacaacatacggcgatgttaccctcgcgaagatctgcggcacaatcgctgccgacgagaagcgacacgagacggcgtacacgaagatagtggagaagctattcgagatcgaccctgacggatctgttcaggcgttagcgagtatgatgaagaaacggatcacaatgccggctcatcttatgcacgacggaagagataacgatttgtttgatcattacgccgccgtggcgcagcggattggagtttacacggcggcggattacgctgggatacttgagtttctgttgcggcggtggaaggtggagagtttgggattggggttatcaggagaaggaaggagagcacaggagtacttgtgcaccttgccgcagaggatcaagaggttagaggaaagagctaatgatagggtcaaacttgtgtcaaaaccttctgtttcgtttagctgggtttttggtagagatgtgaaactatagatagatatttaaaataacaaacaaacaaaaaaaaaccaaacaaatataaataaataaattatgtttgtgatcaggttgcaagttgtcacttgtgaatgtgagtaaccaaactatatagtatatt

SEQ ID NO: 110 - DNA, 1195 bp, Arabidopsis thaliana
gttaatcagagcataaggatttcatctttttctctacaaacttttcaattatctttttctaagagttacaaaagtatatttgttttctatataaatttgggatagtctatctacatttctacaaaattcagctaaccgttaggtgagtcactcatagtcatacatatcttccttctatataaaaaaagaatattagttttgagtggactgataaatatattcttttcaacaagaagaaaacaatcttcttaaacccaaacgttcaagaaaaagaaaaaaaaacgatacttacgatgagtgcggtaaaatcggcgttaggtgatatggtgataacctttttgtgggttattctctcggcgacgtttgggatacagacggcggcgattgtttccgccgtagggtttcatggtatcacttgggctcctcttgtgatctcaacgttggttgtttttgtctccatctcgatttttacggttattggaaacgttcttggtggtgctagcttcaatccttgtggaaacgcagcgttttataccgccggtgtttccagtgattctctcttctccttggccattagatctcctgctcaggcaattggtgcggcaggcggtgcgataacgatcatggagatgataccggaaaagtataagactaggattggaggaaagccttcattgcaatttggtgcacacaatggagctatttctgaagtggtcctaagttttagtgttacatttttggttttactaattatcctaagaggtcctcgaaaactgctcgcgaaaacgttcttgctcgcactcgctaccgtatcggtgtttgtcgtaggttctaaattcactagaccattcatgaatcctgccattgcgtttgggtgggcatatatctacaagtctcacaacacatgggaccatttttatgtgtattggatcagctcctacaccggagctattttatctgcgatgctctttagaattatatttccggctccacctctggttcagaaaaaacagaagaaagcttgagaaaaaaatggaaaaatctaagtaaaaatttcatgaatcataatcccatttgttgtatgttttatgctgttgtcgtatttgtacttaatttatagtttatagcccaaaaaaaaaattcgtttctttttaaaatttatggattcacattttctcggttagtgcgtaatcta

SEQ ID NO: 111 - DNA, 1120 bp, Arabidopsis thaliana
aagggctgagaagagcagacacagcagcgagaggaagcttcttcgactgcgacgtcaccattttcgtgttctctgctttgtaacactttcgggtttagctactgaaagtaagaaaagcgagataacgcattaaagcttttgaagagaacaagatgttgcctaggaatgctactgataagatacaaggaaatgtgagcaagccttgcttttggaagtctctgtctccaggacaaaactggaaatctaaatccatgaggagttttccggaagagtttgtgaaaagcacgcccggggcttttgagcacagagttgtgttcagtgttcgttggggcaattcttggcaactctggctggagcgagaagaaaaagatctgtttatgatagaagaagattgggatgagtttgtggatgacaaccatttaggcccaaatgataacgtgttcttcagacacgatgacaagatgtttcttgaagtgcaaatctttaagaatgatgggaacgagatcatcgatgcacctcctgaagttgaacctgaaactgaaccatttcatcctactacaccaaaaaattctcacaaggagacaaccactgcctctgcctctgcttctgcttctgaattttcagacaattggcgagagacacatggttgtgctgatatcaaaaaccctgagctgtaccttctaaaccccaaaaacccttactttgtgaaaacgctgacaaaagggaatgacgttttgtatgtgcccaaaacagtgattaagaagtatggcttgaagtttggtccccatttgtcccccatgcattaccttcttcccggagataaaataaatggctccactaagatctatggcggtggcagtgccccttgtttcaatggctgggtggacctatgtcgaaagtacaatctgaaaaccggagactctatggtttgtgaacttgaacgctctggagaactggttactgctgttagagtgcacttcatcaataaaacatgagatgagtcctctctagtctcttttctttaacattcgtgtttaccaaacttactattgtaatgtttatatgtgacccttatgttgctttaacaaaacttaaatgctaaatttcttatgcttctgtt

SEQ ID NO: 112 - DNA, 831 bp, Arabidopsis thaliana
gcataacaaatttagagcgagcaataatgagggtttctcaatctctaatcccttttgccataattgctttggtcctttcctttgtcaatgcttatgatccaagtccactccaagacttctgtgttgccattgatgacctaaaaggcgtttttgtgaatggtaggttttgtaaagacccggagcgagtcgatgcaaaagattttttcttctcaggtctcaatgtgcccgggaacaccaataatcaagttggctctaatgtgaccactgttaatgttgatcagatccccgggctaaacaccatgggaatatcattggtccgcatagactacgcaccgcatggccaaaatccacctcacacgcaccctcgtggctcagagatccttgtccttgtcgaaggaacattatacgtcggttttgtctcttccaatcaagataacaaccggttattcgccaaagtattgcaccccggtgatgtttttgtgttccccataggaatgatccattttcagttaaatatcgggaaaattccagcaattgcttttgcgggattgagtagccagaacgctggtgttatcacaattgcaaacactgtgttcgggtcaaaccctccgatttatccagagcttcttgccagggcgttccagttggatgcaaatgttgtcaaagaacttcaagccaagtttgggtccatatgaactgatcatctaagtcgtttaagagtgtttatcattgaaacacaaattaaaggaatacactactatgaaatatttatgtaacaaagtaaaaatggcttatgtacctatttctatattataatataacaactttaat

SEQ ID NO: 113 - DNA, 882 bp, Arabidopsis thaliana
atacatgcataacaaattaagagcgagcaataatgagggtttctcaatctcttgtcccttttgccataattgctttggtcctttcctttgtcaatgcttatgatccaagtccactccaagacttctgtgttgccattgatgacctaaaaggcgtttttgtgaatggtaggttttgtaaagacccgaagcgagtcgatgcaaaagattttttcttctcaggtctcaatatgcccgggaacaccaataatcaagttggctctaatgtgaccactgttaatgttgatcagatcccagggctaaacaccatgggaatatcattggtccgcatagactacgcaccgcatggccaaaatccacctcacacgcaccctcgtggctcagagatccttgtccttgtcgaaggaacattatacgtcggttttgtctcttccaatcaagataacaaccggttattcgccaaagtattgcaccccggtgatgttttcgtgttccccataggaatgatccattttcaggtaaatgtggggaaaattccagcagttgcttttgcgggattgagtagccagaacgcaggtgttatcacaattgcaaacactgtgtttgggtccaatcctccgatttatccagagcttcttgccagggcgttccagttggatgcaagtgttgtcaaagaacttcaggccaagtttgggtccatatgaactgatcatctaagtcgtttaagagtatttatcatcttttacaaaaaaaaagaaaaaaaagtatttatcattgaaacacttaattaaaggaatacactactatgaaatatttatgtaacaaaataaaacctggattatgtaccaagtttctatattataatatatcaacttttcccatata

SEQ ID NO: 114 - DNA, 816 bp, Arabidopsis thaliana
atacatgcataacaaattaagagcgagcaataatgagggtttctcaatctcttgtcccttttgccataattgctttggtcctttcctttgtcaatgcttatgatccaagtccactccaagacttctgtgttgccattgatgacctaaaaggcggtctcaatatgcccgggaacaccaataatcaagttggctctaatgtgaccactgttaatgttgatcagatcccagggctaaacaccatgggaatatcattggtccgcatagactacgcaccgcatggccaaaatccacctcacacgcaccctcgtggctcagagatccttgtccttgtcgaaggaacattatacgtcggttttgtctcttccaatcaagataacaaccggttattcgccaaagtattgcaccccggtgatgttttcgtgttccccataggaatgatccattttcaggtaaatgtggggaaaattccagcagttgcttttgcgggattgagtagccagaacgcaggtgttatcacaattgcaaacactgtgtttgggtccaatcctccgatttatccagagcttcttgccagggcgttccagttggatgcaagtgttgtcaaagaacttcaggccaagtttgggtccatatgaactgatcatctaagtcgtttaagagtatttatcatcttttacaaaaaaaaagaaaaaaaagtatttatcattgaaacacttaattaaaggaatacactactatgaaatatttatgtaacaaaataaaacctggattatgtaccaagtttctatattataatatatcaacttttcccatata

SEQ ID NO: 115 - DNA, 881 bp, Arabidopsis thaliana
atacatgcataacaaattaagagcgagcaataatgagggtttctcaatctcttgtcccttttgccataattgctttggtcctttcctttgtcaatgcttatgatccaagtccactccaagacttctgtgttgccattgatgacctaaaaggcgtttttgtgaatggtaggttttgtaaagacccgaagcgagtcgatgcaaaagattttttcttctcaggtctcaatgtgcccgggaacaccaataatcaagttggctctaatgtgaccactgttaatgttgatcagatcccagggctaaacaccatgggaatatcattggtccgcatagactacgcaccgcatggccaaaatccacctcacacgcaccctcgtggctcagagatccttgtccttgtcgaaggaacattatacgtcggttttgtctcttccaatcaagataacaaccggttattcgccaaagtattgcaccccggtgatgttttcgtgttccccataggaatgatccattttcaggtaaatgtggggaaaattccagcagttgcttttgcgggattgagtagccagaacgcaggtgttatcacaattgcaaacactgtgtttgggtccaatcctccgatttatccagagcttcttgccagggcgttccagttggatgcaagtgttgtcaaagaacttcaggccaagtttgggtccatatgaactgatcatctaagtcgtttaagagtatttatcatcttttaccaaaaaaaagaaaaaaaagtatttatcattgaaacacttaattaaaggaatacactactatgaaatatttatgtaacaaaataaaacctggattatgtaccaagtttctatattataatatatcaacttttcccatat

SEQ ID NO: 116 - DNA, 1775 bp, Arabidopsis thaliana
atgagaacacttgaagcttttgctctgtccctgtttcttgtcttcttagtaaaatgggtcaattctgactctagttcttctcctagtaaagatcaatttctgagttgcatgtcgacacattctgattccagcttcataaaccctaaaagcttcatccacaaaccagattcaagagtctacaccgatttctcgcagtctttaatatcacaaaactacagatttctgaccttgaatttcacaagccagaagccgattctgatcgttacaccaagaactgatactgaaatccagagatcattactctgtagcaggaaacttggggtgaaagtaagaaccaaaagcggtggtcatgactatgaaggcctttcttatctctcattacactcgcctttcatcatactcgatctcgttaatgttcgatcgatcgagatcaacctggcagatgaaacagcttgggttggagccggtgccactatcggtgagctttactataaaattgccaaatcaagtaagatccatggcttccctgcaggaacatgccctagtgttggagttggaggtcattttagcggaggagggtttggtgcaatgatgaggaaacatggtttagctgcagataacgttgtggacgcgcgttttgtagacgcaaatgggaggatctacaacagtaggagagaaatgggagaagatttgttctgggccattagaggaggtggagcagctagctttggtgttgtactttcatggaaagtgaagctagttagggttccagaaaaggttacgtgcttcagaaggaacctaccgttgacacagaacatgacgaaaattgttcatagatggcagcaaattgcagcagagcttgacgataatctcttcatccgagtcatcgtttccatttccggaggatcagttcaaactacattccaagcaaattatcttggaggaatcgataaactaattcctctgatgaatcagaagtttccggaattagggttaacgtttcaagactgttcggaaatgacctggatcgattcaataatgtacttcaactggaagaaaggacaaccactagagactcttctggatcgaggacaaagatacaatgatctgtatttcaaagccaaatctgattttgtcaagaaccctattcctgaaatcggtctagaaggtatatggacgaggtttcacgaggtcgaatctccgataatgataatggagccattaggtggtaaaatgtatgagattggtgaaacagagactccattcccacatagaagagggaatctatataatatccagtatatggttaaatggagattgaaggacattggagtgatggagaaacatgtgacatggatgagattgctttataggtatatgagagtttatgtctctgcatcgccaagaggagcttatttgaattaccgagatcttgatttaggtatgaacagaggagttaatacgagctttgaagatgcgaaattatgggggtttaggtattttggaagtaatttcaagagattggctattgttaaagggaagattgatccaaccaatttcttcaggaatgaacaaagtgttcctcctttgattgtctaagagaaaactaagatttgattcttagacaaaaccaatgtttgtgtgcttatgttcttggacttttatggctctatagatattgtgttgtcctcatgtaacgtcagtgtgaaagtgaccgtgttgtgtggtgttatctcataattctcattataaatatcgttttgatttttctcctt

SEQ ID NO: 117 - DNA, 1120 bp, Arabidopsis thaliana
atggaacgtggaggcttccatggctaccgcaagctgtccgtgaacaacaccactccttctccaccaggattagcagcgaattttctgatggcagagggcagtatgcgtcctccagaattcaaccagcctaacaaaaccagtaatggtggtgaggaggagtgcacggtgagggagcaagacaggttcatgcctattgccaacgtgatacggatcatgcggaggatcttacctgctcacgccaagatctcagatgactccaaggagacgatccaagagtgtgtttcggagtacatcagcttcataacaggggaggctaatgagcggtgccagcgggaacagcgcaagaccatcactgctgaggacgtcttgtgggcaatgagcaagctcggttttgatgactacatcgaacccctcacgttgtacctccaccgctacagagagttggaaggtgaaagaggggttagctgcagtgctgggtccgttagtatgaccaacggcttggtggtcaagaggcctaatgggaccatgaccgagtatggagcctacgggcctgtgccagggattcacatggcgcagtaccattatcgtcatcagaacgggtttgttttcagtggtaacgaacctaattctaagatgagtggttcatcttcaggagcaagtggcgccagagttgaagtatttccgactcaacaacataagtactgagaacaatggctaataacatagacagctgacagagtcataactgttagtaggtgcaagctgtagcttatgaattcaagtttaagcgaaaacaatgctgctttttctttgtttattatctatctagttgaaagaacattgtgtttttcatctgatctgtcttgtggtaaagtatgtcaataaagcattagttttgcaaaccgcatgcatgtgatattacaaaattcacggtgaattcgtaatgcgtcttggttcaaaatagaaagagactaaacattccagatttcaattctcagctacagaaatgagtgtttaacggatacagaaacaactctcacaatcttcattcatttcatttagctactactttccaaaggaacttcaacgcatacctttttcctctccagaagatcatgtt

SEQ ID NO: 118 - DNA, 1834 bp, Arabidopsis thaliana
aacaactggtttcgcttcttcttctacagagcttccctcgtttcctccgccggagagacactccattaaaatcccttcttcatcgatccttcattagatttacaacaacaacaatgccaagcgtcaagctcacacaccattctccacctgacactattgcctccgactccgtccgtctcctttcccgtgaaactctccgaatcagcgcctctctcgcttctcctcccgttgatgatctccctcctcactctcctccacctccagattctcaatttcttcattcgactctgagattgatctgttgcgaagaaatcgatggccgtcggtttaagtatgtcgctgagagcgatggttctgggagattcaagaagaattcagttcgtgctattagcttggagtctcctcagactccttttgatgaagtgggttcgtttcttagatcttacgttgtacctgaaggctttcctgggagtgttaatgagtcttatgttccttatatgacttggagagctttgaaacatttctttggtggagctatgggtgtgtttactactcaaactcttcttaattctgttggagcttcaagaaacagttctgcttctgctgctgttgccatcaattggattctcaaggatggtgctgggcgtgttgggaaaatgctttttgcgaggcagggaaagaaatttgattatgatttgaaacagttacggtttgctggtgatctattgatggagctcggtgctggtgtagagttggcgacggctgcagttccacatctttttcttccactggcttgtgctgctaatgttgttaagaatgttgcagcagtaacatcaacgtctactcgtacaccgatctataaagcctttgctaaaggagaaaacataggagacgtaactgctaaaggagagtgtgttggtaatattgcagatctgatgggaactgggtttagcatcctgatatcaaaaagaaatccttcgttggtcacaacatttggtcttctatcatgtggctatctcatgagctcgtaccaagaggttagatctgtagtattgcatacactaaaccgtgctagatttacagtagcagtggagtcctttcttaagacggggcgggttccctcattgcaggaaggtaatatccaagaaaagatattcacttttccatgggtggatgatcggccagtgatgcttggagccagatttaaggatgcattccaagaccccagcacgtatatggctgtaaagccttttttcgataaagaaagatacatggtaacgtacagccctaccaagggtaaagtctatgcactgctcaaacatcaggctaactcagatgacattctcaaagcagcatttcatgcacatgtgcttcttcatttcatgaatcaatcaaaagatggtaacccaagatcggtggagcaattagatcctgcgtttgctcctacggaatatgagctcgagtctcgtattgctgagtcgtgtgaaatggtttccacatcatatggcgtcttcaaaagcagggctgcagaacagggttggagaatgtcagaatctctgcttaatcctggccgggctaggttatgtcatgtgaaggagggggagtaaacatcgcctgttgagactggtcatcgacctgaatcggcttttatagttatttcactgtcacactctaaattttgctgtcttggtttcatgaagaaaaaaacaggttttggttggtacacgttttattaaccaggctgtaaaaaatagaacgatatgtagcttttgtaaattgtgagaatgccactggtgtaatttaacagatgaatcttctttgtgtaccaattctc

SEQ ID NO: 119 - DNA, 1436 bp, Arabidopsis thaliana
tttttctctcttttaactacaagtctactacaacttccaataagagagaagagacagagcattaatggagtcaccaagccttccgatgacggccaaagactggaccaccaccagtctccaccgtgtcttcgccatgcaaggcggcgaagatgacctcagctacgtcaacaattccgatagccaagctttggctataaccttaagcaaaccaatccttatctcatctctccaatccatcaaactcttctccgaccaaactcccatcaaaatcaccgatctcggctgcgccaccggctccaacacgtttactaccgttgatacggtggttgagacgttacaacggcgatacactgccaggtgcggtggtggtgggtcgccggagtttgaggctttcttctgtgatttgccttctaatgacttcaacatgttgttcaagttgttggctgagaaacagaaagttgactcgccggcgaaatacttcgctggcggcgttgctggttcgttctatgaccggctttttcccagaggaacgattcatgtcgctgtgagcttaagtgccttgcactggctctctcagataccggagaaagtattggagaaagaatcaagaacgtggaacaaagggaaaacgtggatagaaggagcaaagaaagaagtagtagaagcatacgcagagcaatcagacaaagatttggatgatttcatgagctgtaggaaagaagaaatggtgaaaggaggagtgttgtttgtgttgatggctgggcgtccttcaggctcaagtagtcaatttggggaccaagatactcgagccaaacatcctttcacaactaccatggaacaagcttggcaagatttaatagaagagggtttgatagatgaagaaacaagagacggtttcaatattccggcgtacatgagaagtccggaggaagtgacggccggaattgaccgttgtggtggtttcaagatagggaaaatggacttcctgaaaatagttgaatattcagatgagaaacaagaagagtggaagaaagatccggtttcatatggacgagccaggaccaatttggttcaagctgctattcgtcctatggttgatgcttatcttggaccagacctatctcatgagctcttcaaaagatatgaaaatcgtgtttctacaaaccaagaatttctccatataacttgtttttatggagtcgtcgtgttttccgccatccgagtttaatgttgatataatttagctatagattatagatatgaacggaaacattttttttttatgaacggaaacatatgttatgcaaaaaaaaaaaaaaaacagttatgctttgttcgtttccatgtaagatttgtggtagttcatcagatgaattatgtgcgcttgtttaaatttctgaagcttgtagggttgcaaaaaaaacaaaaacaaaaac

SEQ ID NO: 120 - DNA, 1135 bp, Arabidopsis thaliana
gtcctctgtttactttaaaacccgtattttaacttgctgctattcacaacaagaaaaatgaagtcttgtctagctacttttgctctcgcagtgttagtaacacaaggaagcatttttagtttgtgtttggcctcctctgcttctacaaactctgttcctaattggtttcatcattggccgccgtttaaatggggaccaaaatttccatattctccacctaaaccgccgccaatcgagaaatatcctccaccggtgcagtatccaccaccgatcaagaagtatccaccgccaccatacgagcatccaccggtgaagtatccaccaccgatcaagacttaccctcatccgccggtgaagtatcctccaccagaacagtatccaccgccgattaagaagtatcctccaccagaacagtatccaccgccgattaagaagtatcctccaccagaacagtattcaccgcctttcaagaagtatcctccgccagaacagtatccaccaccgatcaagaagtatcctccgccagaacattatccaccgccgataaaaaagtatcctccgcaagaacagtatccaccaccgattaaaaagtatcctccgccagaaaagtatccacccccgatcaagaagtatcctccgccagaacagtatccaccgccgatcaagaagtatcctccgccaattaagaagtatcctccgccagaagagtatccaccaccgatcaagacttatcctcatccccctgtgaagtatccaccgcctccgtacaagacttaccctcatccgccgatcaaaacttatcctcctccgaaagaatgtcctcctccgcctgaacattacccttggcctccgaaaaagaaatatcctccaccggttgagtatccgtcgccgccatataagaaatatcctccggctgatccatagtaactcaaaaccaaacaaggacgtgtttgtctataagtatatgtctagttaaaaaactgttctgttctttctgttatgttctttctttttcttatgactttctgttatgatgcatcaaataaagaataaactgttctgttttgaatttgttaaataggagagtgcaagctcaagaacaagctgtttcataaataaataaaatatattttct

SEQ ID NO: 121 - DNA, 1241 bp, Arabidopsis thaliana
atttagtggtccaaattaaaaagggtgataaaaattgagttacagaaacgacgaagacgattcttcccatggcttcttcactggagaagcttatttcaagctttctacttgtcttgtactccaccaccatcattgttgcttcatcagaatctcgatgtaggcgttttaaatcgatcatcagctttggtgattccatcgccgacaccggaaattatctccatctctctgatgttaaccaccttcctcaatccgcctttcttccttatggcgaaagcttcttccatcctccctccggccgttactcggacggccgtctcatcatcgactttatagctgaattcttgggactaccgtacgtaccatcttattttggatcccaaaacgtgagctttgatcaaggtatcaatttcgcggtgtatggtgcaactgcattggatcgtgtgtttcttgtgggaaaaggaattgaatctgatttcaccaatgttagtttaagtgttcagcttaacatcttcaaacagattttacctaatctttgcacctcgtcttctcgtgattgcagagagatgcttggagactcgctgatacttatgggtgagattggagtaaatgactataattaccctttctttgaaggcaaaagtatcaatgaaatcaaacagcttgttcctctagtcatcaaagctatttcttctgctattgtggatttgattgatttagggggcaaaacgtttctggtccctggaaacttcccattaggatgctatcccgcgtatctcactctatttcagaccgcggcagaagaagaccacgaccctttcacaggttgtatcccacggctcaatgaattcggagagtaccacaacgaacagctcaagacagaactcaaaagactccaagaactatacgatcatgtcaatatcatttacgccgactactacaactctttgttccggttatatcaagaaccagtcaaatatgggtttaagaacagacctttggctgcttgttgcggagtcggaggtcaatacaacttcactattggtaaagagtgtggacacagaggagttagctgttgtcaaaatccttctgaatatgtgaattgggacggttatcatttaaccgaggccacacaccagaagatggctcaagttatactcaacggtacctatgcatcacctgctttcgactggtcctgctctggctctgaatcagtggataaagagtattctttcagcagttaa

SEQ ID NO: 122 - DNA, 672 bp, Arabidopsis thaliana
agctctctccctctccctctccctctccatctctctgctcgcttgtgacagtaaacatgggagctctcaattatctttctgagtatttctctaaccatttctacgtctcaatacgaaaacggaagaaacgtaaagtcatgcagacggtgaatattaaggtgaagatcgactgtgacggatgcgaacgcaaaatcaagaacgctgtttcctccatcaaaggagcaaaatcagtggaagtgaacagaaagatgcacaaagtaacggtgagtggctacgttgatcccaagaaagtgctgaagacagtgcagagcactgggaaaaagaaagctgagctgtggccgtatgttccatacacaatggtggcttatccatatgccgccggagcttacgacaagagagccccgccgggttttgtgaggaagtcggagcaggctcaggcgcagccgggaagtactgacgataagctcatgtccctctttagcgacgagaaccctaacgcctgcaccgttatgtgaataagtatagatagcatgagccgatgttataatttgtaatgtataacgttttatgaagttaaagtactggaaccttttttgttactgtattatgtgagaagcaacgcaacatatagtaattactctgcgtttaactagtagattatttaatgatata

SEQ ID NO: 123 - DNA, 2868 bp, Arabidopsis thaliana
agcgatcaaaaaaatcttcattaaaagaaccctaaatctctcatatccgccgccgtctttgcctcattttcaacaccggtgatgacgtgtaaatagatctggttttcacggttctcactactctctgtgatttttcagactattgaatcgttaggaccaaaacaagtacaaagaaactgcagaagaaaagatttgagagagatatcttacgaaacaagcaaacagatgttgttgtcggcgcttggcgtcggagttggagtaggtgtgggtttaggcttggcttctggtcaagccgtcggaaaatgggccggcgggaactcgtcgtcaaataacgccgtcacggcggataagatggagaaggagatactccgtcaagttgttgacggcagagagagtaaaattactttcgatgagtttccttattatctcagtgaacaaacacgagtgcttctaacaagtgcagcttatgtccatttgaagcacttcgatgcttcaaaatatacgagaaacttgtctccagctagccgagccattctcttgtccggccctgccgagctttaccaacaaatgctagccaaagccctagctcatttcttcgatgccaagttacttcttctagacgtcaacgattttgcactcaagatacagagcaaatacggcagtggaaatacagaatcatcgtcattcaagagatctccctcagaatctgctttagagcaactatcaggactgtttagttccttctccatccttcctcagagagaagagtcaaaagctggtggtaccttgaggaggcaaagcagtggtgtggatatcaaatcaagctcaatggaaggctctagtaatcctccaaagcttcgtcgaaactcttcagcagcagctaatattagcaaccttgcatcttcctcaaatcaagtttcagcgcctttgaaacgaagtagcagttggtcattcgatgaaaagcttctcgtccaatctttatataaggtcttggcctatgtctccaaggcgaatccgattgtgttatatcttcgagacgtcgagaactttctgttccgctcacagagaacttacaacttgttccagaagcttctccagaaactcagtggaccggtcctcattctcggttcaagaattgtggacttgtcaagcgaagacgctcaagaaattgatgagaagctctctgctgttttcccttataatatcgacataagacctcctgaggatgagactcatctagtgagctggaaatcgcagcttgaacgcgacatgaacatgatccaaactcaggacaataggaaccatatcatggaagttttgtcggagaatgatcttatatgcgatgaccttgaatccatctcttttgaggacacgaaggttttaagcaattacattgaagagatcgttgtctctgctctttcctatcatctgatgaacaacaaagatcctgagtacagaaacggaaaactggtgatatcttctataagtttgtcgcatggattcagtctcttcagagaaggcaaagctggcggtcgtgagaagctgaagcaaaaaactaaggaggaatcatccaaggaagtaaaagctgaatcaatcaagccggagacaaaaacagagagtgtcaccaccgtaagcagcaaggaagaaccagagaaagaagctaaagctgagaaagttaccccaaaagctccggaagttgcaccggataacgagtttgagaaacggataagaccggaagtaatcccagcagaagaaattaacgtcacattcaaagacattggtgcacttgacgagataaaagagtcactacaagaacttgtaatgcttcctctccgtaggccagacctcttcacaggaggtctcttgaagccctgcagaggaatcttactcttcggtccaccgggtacaggtaaaacaatgctagctaaagccattgccaaagaggcaggagcgagtttcataaacgtttcgatgtcaacaataacttcgaaatggtttggagaagacgagaagaatgttagggctttgtttactctagcttcgaaggtgtcaccaaccataatatttgtggatgaagttgatagtatgttgggacagagaacaagagttggagaacatgaagctatgagaaagatcaagaatgagtttatgagtcattgggatgggttaatgactaaacctggtgaacgtatcttagtccttgctgctactaatcggcctttcgatcttgatgaagccattatcagacgattcgaacgaaggatcatggtgggactaccggctgtagagaacagagaaaagattctaagaacattgttggcgaaggagaaagtagatgaaaacttggattacaaggaactagcaatgatgacagaaggatacacaggaagtgatcttaagaatctgtgcacaaccgctgcgtataggccggtgagagaacttatacagcaagagaggatcaaagacacagagaagaagaagcagagagagcctacaaaagcaggtgaagaagatgaaggaaaagaagagagagttataacacttcgtccgttgaacagacaagactttaaagaagccaagaatcaggtggcggcgagttttgcggctgagggagcgggaatgggagagttgaagcagtggaatgaattgtatggagaaggaggatcgaggaagaaagaacaactcacttacttcttgtaatgatgatgatgaatcatgatgctggtaatggattatgaaatttggtaatgtaatagtatggtgaatttttgtttccatggttaataagagaataagaatatgatgatattgctaaaagtttgacccgtatgtttggtctgtcattatgaaatcatactatatttgagt

SEQ ID NO: 124 - DNA, 2886 bp, Arabidopsis thaliana
agagaagcgatcaaaaaaatcttcattaaaagaaccctaaatctctcatatccgccgccgtctttgcctcattttcaacaccggtgatgacgtgtaaatagatctggttttcacggttctcactactctctgtgatttttcagactattgaatcgttaggaccaaaacaagtacaaagaaactgcagaagaaaagatttgagagagatatcttacgaaacaagatcaaatggacagcaaacagatgttgttgtcggcgcttggcgtcggagttggagtaggtgtgggtttaggcttggcttctggtcaagccgtcggaaaatgggccggcgggaactcgtcgtcaaataacgccgtcacggcggataagatggagaaggagatactccgtcaagttgttgacggcagagagagtaaaattactttcgatgagtttccttattatctcagtgaacaaacacgagtgcttctaacaagtgcagcttatgtccatttgaagcacttcgatgcttcaaaatatacgagaaacttgtctccagctagccgagccattctcttgtccggccctgccgagctttaccaacaaatgctagccaaagccctagctcatttcttcgatgccaagttacttcttctagacgtcaacgattttgcactcaagatacagagcaaatacggcagtggaaatacagaatcatcgtcattcaagagatctccctcagaatctgctttagagcaactatcaggactgtttagttccttctccatccttcctcagagagaagagtcaaaagctggtggtaccttgaggaggcaaagcagtggtgtggatatcaaatcaagctcaatggaaggctctagtaatcctccaaagcttcgtcgaaactcttcagcagcagctaatattagcaaccttgcatcttcctcaaatcaagtttcagcgcctttgaaacgaagtagcagttggtcattcgatgaaaagcttctcgtccaatctttatataaggtcttggcctatgtctccaaggcgaatccgattgtgttatatcttcgagacgtcgagaactttctgttccgctcacagagaacttacaacttgttccagaagcttctccagaaactcagtggaccggtcctcattctcggttcaagaattgtggacttgtcaagcgaagacgctcaagaaattgatgagaagctctctgctgttttcccttataatatcgacataagacctcctgaggatgagactcatctagtgagctggaaatcgcagcttgaacgcgacatgaacatgatccaaactcaggacaataggaaccatatcatggaagttttgtcggagaatgatcttatatgcgatgaccttgaatccatctcttttgaggacacgaaggttttaagcaattacattgaagagatcgttgtctctgctctttcctatcatctgatgaacaacaaagatcctgagtacagaaacggaaaactggtgatatcttctataagtttgtcgcatggattcagtctcttcagagaaggcaaagctggcggtcgtgagaagctgaagcaaaaaactaaggaggaatcatccaaggaagtaaaagctgaatcaatcaagccggagacaaaaacagagagtgtcaccaccgtaagcagcaaggaagaaccagagaaagaagctaaagctgagaaagttaccccaaaagctccggaagttgcaccggataacgagtttgagaaacggataagaccggaagtaatcccagcagaagaaattaacgtcacattcaaagacattggtgcacttgacgagataaaagagtcactacaagaacttgtaatgcttcctctccgtaggccagacctcttcacaggaggtctcttgaagccctgcagaggaatcttactcttcggtccaccgggtacaggtaaaacaatgctagctaaagccattgccaaagaggcaggagcgagtttcataaacgtttcgatgtcaacaataacttcgaaatggtttggagaagacgagaagaatgttagggctttgtttactctagcttcgaaggtgtcaccaaccataatatttgtggatgaagttgatagtatgttgggacagagaacaagagttggagaacatgaagctatgagaaagatcaagaatgagtttatgagtcattgggatgggttaatgactaaacctggtgaacgtatcttagtccttgctgctactaatcggcctttcgatcttgatgaagccattatcagacgattcgaacgaaggatcatggtgggactaccggctgtagagaacagagaaaagattctaagaacattgttggcgaaggagaaagtagatgaaaacttggattacaaggaactagcaatgatgacagaaggatacacaggaagtgatcttaagaatctgtgcacaaccgctgcgtataggccggtgagagaacttatacagcaagagaggatcaaagacacagagaagaagaagcagagagagcctacaaaagcaggtgaagaagatgaaggaaaagaagagagagttataacacttcgtccgttgaacagacaagactttaaagaagccaagaatcaggtggcggcgagttttgcggctgagggagcgggaatgggagagttgaagcagtggaatgaattgtatggagaaggaggatcgaggaagaaagaacaactcacttacttcttgtaatgatgatgatgaatcatgatgctggtaatggattatgaaatttggtaatgtaatagtatggtgaatttttgtttccatggttaataagagaataagaatatgatgatattgctaaaagtttgacccgtatgtttggtctgtcattatgaaatcatactatatttgagt

SEQ ID NO: 125 - DNA, 1272 bp, Arabidopsis thaliana
acaaaacacaaaaatggtggtgaaaaactcgatcaaattcaactctcagagtgagcgcaagtctttggaagagaccaaggttcctcctatctttggccttcctccagatgccttagacgacaagaaacctacctcggattttgcagtacctatcatcgactttgcaggcgtccacaagtcgcgtgaagccgttgtggagaagatcaaagccgctgcagagaattggggaattttccaggtgatcaaccatggtgttcctttaagtgttcttgaagagattcaaaatggagttgttaggtttcatgaggaagatccggaggttaagaaatcttacttctcgcttgacctcaccaaaacatttatctaccacaataatttcgaactttacagttcgtctgctggtaactggagagactctttcgtttgttacatggatcccgatccttcaaaccctgaagatctcccagtggcttgcagagatgctatgatcggatactcgaagcatgtgatgagtttaggtggcttgctctttgaacttctctcagaagctcttggtttgaactctgatactcttaagagtatgggttgcatgaagggtttgcatatgatctgccattattaccctccctgtccacaacctgaccaaaccttaggcacaagtaagcattccgacaacacttttatcactattcttcttcaggacaacatcggtggtcttcaaattcttcatcaagactgttgggttgatgtctcgcctcttcccggggcacttatcatcaacatcggagatttcttgcagctaatgacgaacgacaagttcataagcgttgatcatagggtgcttacaaacagagttggaccgaggatttcaatcgcatgctttttcagctcgagtatgaatccaaattccacagtttacggaccaatcaaagagcttctctctgaagaaaaccctccaaaatacagagacttcactataccagagtactcaaagggatacattgagaaaggtctcgatggaacatcgcatctgtcacattacaggatttgagatctttaaaaaaacaaaatatatcctgtttgaagcaagatattcagatatgtctatgttccgtcctttccttatccatgtaaaagctagtactctgttcttgaggctgcaactgcaataacaaaagcattgtaccaaagataagaaacaaatggtgtgtgtgtgtgtatttgttgaaacatgtgtggtttatattggatctttagattcaaactttgttt

SEQ ID NO: 126 - DNA, 1123 bp, Arabidopsis thaliana
atattctcacatctataaagagagcataagactcagagagatctagaggaagagagagagagaaagatgggtaggcctccatgctgtgacaagatagggatcaagaaaggaccatggactcctgaagaagatatcattcttgtttcttacattcaagaacatggtcctggaaactggagatcagttcccaccaacactgggttattgagatgcagcaaaagttgtagactgagatggacaaattatctgagacctggaattaaacgtggaaactttactcctcatgaagaaggaatgatcattcacttgcaagccttattgggtaacaaatgggcgtccatagcttcatacctaccacaaagaacggacaatgatatcaagaactactggaacacacatttaaagaagaagctcaacaagtctgacagtgatgagaggagcagatcagagaacattgcgctgcaaacttcttcgacaagaaacaccattaatcatagatctacctatgcttcaagcaccgaaaacatttcccgccttcttgagggttggatgagagcgtctccaaagagtagtacaagtactactttcttggaacacaaaatgcagaaccggacaaacaatttcatcgatcatcacagcgatcagtttccatacgagcagcttcaaggttcttgggaagagggtcatagcaaaggaatcaacggggatgatgaccagggtataaagaattcagagaataacaacggtgatgatgttcatcatgaagatggtgatcatgaggatgatgatgatcataatgctacaccaccattgacatttattgagaaatggcttttggaggaaacaagtactactgggggtcaaatggaagagatgagccacttgatggagctctctaatatgctttaattgtgacattttctcctttattttttctttatccttgtgaatcttataaatgagactactaattttatatacacaaataaagaaaccagaaagacataatatcatgtgttgttttttggtttctctaagatataagtagctaaaatgctcactgcataagttgtaactaatctaaagttgtctacccatttacatgaataaaatccaatttaag

SEQ ID NO: 127 - DNA, 953 bp, Arabidopsis thaliana
tcctcatgaagaaggaatgatcattcacttgcaagccttattgggtaacaagtaatctcagacaaaaggatctacatctctttatacttgaatgttttgtgtatatattttgatgatgtgaaccctaaactggcttatttgtttacatatggttgtggtaagatgggcgtccatagcttcatacctaccacaaagaacggacaatgatatcaagaactactggaacacacatttaaagaagaagctcaacaagtctgacagtgatgagaggagcagatcagagaacattgcgctgcaaacttcttcgacaagaaacaccattaatcatagatctacctatgcttcaagcaccgaaaacatttcccgccttcttgagggttggatgagagcgtctccaaagagtagtacaagtactactttcttggaacacaaaatgcagaaccggacaaacaatttcatcgatcatcacagcgatcagtttccatacgagcagcttcaaggttcttgggaagagggtcatagcaaaggaatcaacggggatgatgaccagggtataaagaattcagagaataacaacggtgatgatgttcatcatgaagatggtgatcatgaggatgatgatgatcataatgctacaccaccattgacatttattgagaaatggcttttggaggaaacaagtactactgggggtcaaatggaagagatgagccacttgatggagctctctaatatgctttaattgtgacattttctcctttattttttctttatccttgtgaatcttataaatgagactactaattttatatacacaaataaagaaaccagaaagacataatatcatgtgttgttttttggtttctctaagatataagtagctaaaatgctcactgcataagttgtaactaatctaaagttgtctacccatttacatgaataaaatccaattt

SEQ ID NO: 128 - DNA, 981 bp, Arabidopsis thaliana
atggatgagaccaagatcccaaagaaactgcaaagcgatgacgaagaaaacataagtttgatttcttcacttccctttgacgtagatttcgacagcacgaagctcttcaaataccaaggatgttggtacgacgacaaaactctgcaaggagtcctcaattttcaaagaggtttcgagccacaagacaccgatataattattgcttcgttccccaaatctggcactacttggctcaaagctctcacggtagctctcctcgagagatccaaacagaaacactcttctgatgatcatcctcttctacttgataatcctcatggactggtaccattcctcgagctcaggctgttcactgagacctcgaaaccagatctgaccagtatctcatcgtcgccgaggttattttcgactcatgtggcgttccaaacgctgcgagaggctctcaaaaactctccttgtaagatcgtttacgtgtggaggaacgtgaaagacgtactggtgtcgttttggtatttcaacagcgcaaaactaaagatagaagaggagagaagcattttggattcaatgttcgagtccttttgcagaggagttatcaattacggaccatcctgggaacatgtcttgaactattggagagcaagcttggaagactccaagaatgtgcttttcttgaagtacgaggagttaaaaacagaacctcgcgtgcagctgaagagacttgccgagttcttggattgtccttttacggtggaagaagaagagaggggatcagtggaagagatcttggacctttgctcattgcgtaacttgaagaatttggagatcaacaagaccggaaaaacgcttaggggggccgatcacaagattttttttcgtaaaggggaagtcggtgactcgaagaatcatctgactcctgaaatggagaagataattgacatgatcactgaggagaaatttgaaggttcggatttgaaattctga

SEQ ID NO: 129 - DNA, 1158 bp, Arabidopsis thaliana
atgacgacgactctcctcatggcttcgctcatcgtaagctttctacttatcttatactacaccacaatagtcgttgcctcatcagaatctcggtgtcggcgttacaaatcaatcatcagcttcggtgattccattgcggacaccggaaattatgttcatctctccaacgtcaataatcttcctcaagccgcatttcttccttacggcgaaagcttcttccatcctccctccggccgttactcggacggccgtctcgttatagatttcatcgccgaattcttgggactaccgtacgttccgccttacttcggatcccaaaacgtgagcttcaatcaagggataaattttgctgtgtatggagcaaccgccttggatcgtgcctttcttgtaaaacaaggaattaaatctgacttcaccaatattagtctaagtgttcagcttaacaccttcaagcagattttacctaacctttgtgcctcatctactcgtgattgcagagagatgcttggagactcgctgatactcatgggagagattggtggaaacgactataattacccattttttgaaggaaaaagtatcaatgaaatcaaagagcttgttcctctaatcatcaaagctatttcttctgctattgtggatttgattgatttgggaggaaaaacattcctggtacccggaaacttcccaataggatgttccacggcatatcttactctatttcagaccgcgacagtagaacacgacccttttacaggttgtatcccatggcttaacaaattcggagagcaccataacgaacaacttaagatagaactcaaacaactccaaaaactctaccctcatgtcaacatcatttacgccgactactacaactctttgtacggactttttcaagaaccagccaaatatggttttaagaacagacctttggctgcttgttgtggagtcggaggtcaatacaacttcactattggtaaagagtgtggagaaaacggagttagctattgtcaaaatccttctgagtatgtgaattgggatggttatcatttaaccgaagccacgtaccagaagatggctcagggtttactcaatggtcgctatacaactcctgctttcgactggtcctgccttggctcttatgatttcagtggataa

SEQ ID NO: 130 - DNA, 621 bp, Arabidopsis thaliana
atggcttcgagtccacgctggacggaggacgacaacaggcgttttaagtcagctctgtcgcaattccctccggataacaagcgtttggtgaatgtcgcccagcatctgccgaaacctttggaggaggtgaagtactactacgaaaagttggtcaacgatgtttatctgccgaaacctttagagaatgtcacccagcatctgcagaaacctatggaaatggaggagatgaagtacatgtacgaaaagatggccaacgatgttaatcagatgcccgagtacgtaccactggcggaatcgagtcagtccaaacgcaggaagaaggatacgccaaatccttggacagaagaggaacacagattgtttctgcaaggattgaaaaagtatggggaaggagcttcgacgttgacatcaacgaattttgtgaagacaaagactccacggcaagtgtcaagccatgcacagtattacaaaaggcaaaaatcggacaataagaaggagaaacgccggagtatttttgacataactttggagtctaccgagggcaatccagattctggaaatcagaaccctccggatgatgatgatccgtcccaaggtcaaggcacttgtcttggagtttag

SEQ ID NO: 131 - DNA, 1800 bp, Arabidopsis thaliana
acaacagccacttggtttcttattcgcttccctttcttgaattgtgatctttttgaggtgacaaatggagatttcggagagagctagagctcgattagccgttctcaatgcgcacttgacagtatctgagccgaatcaggtgttgccagcgatcgaaccatggtgcacatcggctcacataaccgctgcaccgcatggatcgcttaaaggaaatttgaagatcgtcgatgagcgtacggggaatgaatatcaggtcccagtctcagagcatggtaccgttaaaaccgttgatctcaagaagataacgacagggaaggatgacaaggggcttaacttatacgatcctggttacttaaacacggctcctgttcgatcttcgatttcttacatcgatggagatgagggaatcctacgttatcggggatacccagttgaggagttggctgagaaaagtacttatacagaggttacttatctcctaatttatgggaatctgccttctcaaagacagctagctgattgggagtttgcgatttctcagaattcagctgtgccacaaggagtattggatatgatacagtccatgcctaatgatgtacatccagtaggagctcttgtcactgcaatgagtgcactttccatcttttatcctgatgcaaatccgtctcttatgggcctaggtgtttacaagtcaaaacaagttcgtgataaacagattgttcgtgttcttggacaggccccaacaattgcagcagctgcttatttgaggaaggcaggcaagcctcctgttcaacctttgagcaacctttcttattcagagaatttcctctatatggtggaatcaatgggagataggtcttacaagcctaatcctcgtttggctcgagtgctggacatcctcttcatactgcaagctgaacatgaaatgaactgctctactgctgctgctaggcacctttcctctagtggtggtgatgtgtatactgctgtttcgggaggtgttggagccatttatggtccccttcatggtggtgcagttgaggctacgattaacatgttatcagagattgggactgttgaaaatattccagagttcattgaaagcgtgaagaataagaagaggaggttgtcgggttttggacaccgcatttacaaaaactacgatcccagaggaaaagtcgttaagaaactggcggatgaagtgttctccattcttggaagggatcctctggttgaggtaggagatgctctagagaaggcggcactttctgatgaatattttgttaagagaaagctgtacccaaatgttgatttctactctggattaatcaatagggcaatgggaatcccatcatcattcaccgcagtatcacgtatcgctggatacttgtcacactggcgtgagtctttagatgatcctgacacaaagatcatgagaccccaacaggtctatactggagcggggataaggcattacgagacagtgagagaaagaaccaagctgtgattcggatttggatcagttgggtcaagtttccatttcgaatgcatcaagaaggcgttagctgggtcaagtctcgttcctatactactaatatgaaatttgactcggaaagccaagcgaatatacaaatatatataaagaatatatatgcttatataaaatatagtttgggtaaaccccatccgacctcgagttagtaatacatgtgtgtgtgtctatgtatgtataagttgtcaaaataaaataaaaatatttgtgtattatagcatgtttttaagaatatgatgttgaacaat

SEQ ID NO: 132 - DNA, 592 bp, Arabidopsis thaliana
cgaatcataagagcaaaacttaaagaagtaaagaaccatgtcgctagacgcgaatacttgttctatcgtcttctttctattcttcactgtctctttcgccgtctccggccaaaagccaaccgcttacgacgccgtcaaactctataacttaccaccaggaatcctcccaaaaggagtggttgactatgagcttaacccaaaaacaggcaacttcaaagtctacttcaatgacacgtgtgaattcaccatccaatcctaccagctcaagtacaaatcaactatctccggcgttatatcacccggtcatgtcaagaatctgaaaggagttagtgttaaggttcttttcttctgggttaatattgctgaagtgtctcttgacggcgccgatctcgacttctccgtcggaatcgcgtcggcgagttttccggctgctaattttgaagagagtcctcagtgtggttgtgggtttgattgtaataatgggcttttattttcttcttgaatctgttgggccttgtgttgtactgaataaaaaatgcccttctcttatgattggcttatgagtattgattagttaattaataaattgatt

SEQ ID NO: 133 - DNA, 1842 bp, Arabidopsis thaliana
attgaataacaaaaaaaaaaacagagcacaatgactagatttgcggtattgccactctctgttcttcttctcgttctcttgttcctctgcactgagtcgttggctaagtcggaggagtctgaagaatacgacgtcgctgtgccttcatgttgcgggttttcgtctcctcttctgattaagaaagatcaatggaaaccaatcttcgagacgaagtttggacagatctcaaccgttcaaatcggcaatggatgcggtggaatgggaccttacaagatacattccataacgttggagccaaacacaattttgctccctcttcttcttcattccgacatggtcttcttcgttgactctggaagtgggattctgaattgggttgacgaggaagcgaagagtaccgagatcagactaggagacgtttacaggctacgtcccggttcggttttctacttacagagcaaaccggtggatatcttccttggaaccaaacttaagctttacgcaatcttctccaacaacgatgagtgtttacatgatccttgctttggtgcctattcgagtatcacagatctaatgtttggttttgatgagacaattctccagtcagcttttggggttcctgaggggattatagagctgatgaggaaccgtacgaagccaccattgatcgtgagtgagacgctttgcacaccaggtgtggccaacacttggcagctccaaccgcgattactaaagctctttgctggaagtgcagacttggtggataacaagaagaagaaagagaagaaagagaagaaggagaaggtgaagaaagcgaagacattcaatgttttcgaatctgaaccggatttcgagagcccctacggtcgtactataacgattaacaggaaggatctgaaagttttaaaaggctcaatggttggagtttccatggtgaatctcactcaaggatcgatgatgggaccgcactggaatccatgggcttgcgagatttcgattgtattgaaaggagcaggaatggttagggttcttaggtcttcgatatcatcaaacacatcatcagagtgtaagaacgtgaggtttaaagtagaggaaggagatattttcgcagttccacggttacatccaatggctcaaatgtctttcaacaatgactcgttagtgttcgttgggtttactacttcagctaagaataacgagccgcagttcttagccggggaggactcggctttgcggatgcttgaccggcaagtattggctgcatcgcttaatgtgagtagtgtgacgattgatggattgttgggagctcagaaggaagctgttatcttggaatgtcattcttgtgcggaaggagagatagagaagcttaaggtggagatagagaggaagaaaatagatgatgagaggaagaggagacatgatgaaaggaagaaagaagaagaagaggcgaagagagaagaggaagagaggaggaaacgtgaagaagaagaagagaagaagcggtggccacctcaacaaccaccacaagaagaagaacttagggaacggcaactaccgatggagaaagaatgggaaatggaaggtgaagaggagagttaagccggaggagtaaaagagaaggccaacgtacgtcaagagtgtgtttggtttgttgttagtggttagaactttggttctgacctctcttgtaactttttttttccatagtcttgtttatttgttaatgtacttttgcattgtttttgttgttgccatgtttaaagttgtattgtgtttgtataatgttttgttttgtttaaatctttgtagatggtaaatgagaaataagtaaatatttccgag

SEQ ID NO: 134 - DNA, 1607 bp, Arabidopsis thaliana
cccaaatgccgcttacgtactattccctgcacctaagtttccctctcgcacctatatataccactcctttcctctcccacttaccgaccactgtactgaatctttaagcctctcaacgtgttttttatatatattttgaaaatcttttacgccttaaaaggatctacgataattaaaaaaaaatggcaacggaatgcattgcaacggtccctcaaatattcagtgaaaacaaaaccaaagaggattcttcgatcttcgatgcaaagctccttaatcagcactcgcaccacatacctcaacagttcgtatggcccgaccacgagaaaccttctacggatgttcaacctctccaagtcccactcatagacctagccggtttcctctccggcgactcgtgcttggcatcggaggctactagactcgtctcaaaggctgcaacgaaacatggcttcttcctaatcactaaccatggtgtcgatgagagcctcttgtctcgtgcctatctgcatatggactctttctttaaggccccggcttgtgagaagcagaaggctcagaggaagtggggtgagagctccggttacgctagtagtttcgtcgggagattctcctcaaagctcccgtggaaggagactctgtcgtttaagttctctcccgaggagaagatccattcccaaaccgttaaagactttgtttctaagaaaatgggcgatggatacgaagatttcgggaaggtttatcaagaatacgcggaggccatgaacactctctcactaaagatcatggagcttcttggaatgagtcttggggtcgagaggagatattttaaagagtttttcgaagacagcgattcaatattccggttgaattactacccgcagtgcaagcaaccggagcttgcactagggacaggaccccactgcgacccaacatctctaaccatacttcatcaagaccaagttggcggtctgcaagttttcgtggacaacaaatggcaatccattcctcctaaccctcacgctttcgtggtgaacataggcgacaccttcatggctctaacgaatggaagatacaagagttgtttgcatcgggcggtggtgaacagcgagagagaaaggaagacgtttgcattcttcctatgtccgaaaggggaaaaagtggtgaagccaccagaagaactagtaaacggagtgaagtctggtgaaagaaagtatcctgattttacgtggtctatgtttcttgagttcacacagaagcattatagggcagacatgaacactcttgacgagttctcaatttggcttaagaacagaagaagtttctaaaattgaggagacaatgttgtggtccagaaggtcacttgtagttatgtatagagctttcactgtttttcttaagatgttcaagacttgttaaggatcggagacttttttgttcttttattatcttgctctaggttgtctggtgttaaataaaagtagcaaaaaaataaaaatatatgtactccattgggtctacttatgatttgtttcgaaatggtttttttatagtctctaatgttaaatttatgtcactattactattattaaatgaagtttatcaagtac

SEQ ID NO: 135 - DNA, 1014 bp, Arabidopsis thaliana
atggtggtgatgaaggcacagccactggttccagcaattttcatatttggtgattcggtggttgatgtgggaaacaacaatgatatctacacaatcgtcaaagctaatttccctccttatggaagagatttcacaacccatacacccaccggacgcttctgcaatggaaagttagctactgacttcaccgctgagaatcttgggttcaaatcatacccacaagcttatctaagcaaaaaggcaaaaggcaagaaccttttgattggagctaatttcgcctctgcagcctctggttattacgatggcacagccaagctctacagtgcaatatcgttgccgcaacagctagaacattacaaagactacattagtcgaatccaagaaatcgcaacctcaaacaacaattcaaacgccagtgccataatctccaatggcatctatatcgtcagcgcagggagcagcgacttcatacaaaactactatatcaaccctctcctctacagagaccaatcacctgatgagttctctgatctccttatcctctcctactccagttttattcagaatttatattcgttaggagcaagaaggatcggagtgactacacttccgcccctcggttgtttaccggcggccataactgtagtgggtccacatgagggtggatgctcggagaagcttaacaacgacgcaatctccttcaacaacaaactcaatacgacgtcacaggatctcaagagaaacctcattggactcaatttagtcgtctttgatatctatcagcctctctatgatcttgccaccaggccatcagaatttggatttgcagaggcaagaagagcttgttgtggaacagggttactagagacatcaatactgtgcaacccaaaatcagtaggaacatgtaacaatgcaactgagtatgtcttttgggacggatttcatccaacggaagctgctaacaagattctcgctgacaatctcttggtctctggcatctctctcatctcctga

SEQ ID NO: 136 - DNA, 1127 bp, Arabidopsis thaliana
aaaaaaagtaaagaaaagaaaaactaataaagaacaaaaaaaatgtcctcttcttcatcaagaaacgcctttgaagatggcaaatacaaatcaaatctcttaaccttggactcatcatctcgttgctgcaaaataacaccgtcttctagagcttcaccgtctccgccaaagcagctgttggtggctacgccggtggaggaaggagattatccggtggtgatgctcctccatggttaccttctctacaactccttctattctcagcttatgttgcatgtctcttctcatggcttcatcctcatcgctcctcagttatatagtatcgccggaccagacacaatggatgagattaaatcaacggcggagattatggattggttatcagtaggacttaatcactttcttccagcgcaagtaacaccaaacctatccaaatttgccctctccggccatagccgcggtggcaaaaccgcgtttgcggtcgccttaaagaaatttgggtactcctcgaatctaaagatctcgacattgatcggtatagatccagtcgatggaacagggaaagggaaacaaacccctcctccggtgttggcttaccttccaaactcatttgacctagacaaaacgcctatacttgtgatcggttcggggcttggtgaaaccgctcggaacccattattcccaccgtgtgcacctcccggagtgaatcaccgagagttctttcgggaatgtcaaggtccagcatggcatttcgttgcgaaggattatgggcatttggacatgcttgatgatgatacaaaagggattagagggaagagttcttattgtttgtgtaagaatggtgaagagaggagaccaatgaggagattcgttggtggacttgttgtatcatttttgaaggcttatttggaaggagatgatcgtgaattagttaagatcaaagatgggtgtcacgaggatgttcccgttgaaattcaagagtttgaggttatcatgtaaacataagtttttctttaggggctggtttttctattgtcaatatcatcagcttttgttgcttatggttttacaaacttatattgtacaactctttaagtcacctctttgcttatgatattaacccgatc

SEQ ID NO: 137 - DNA, 1690 bp, Arabidopsis thaliana
cctattcccaaagatgaagaacaataacaacaaatcttcttcttcttctagctatgattcttctttgtctccttcttcttcatcctcctcccaccagaactggctctctttctctctctccaacaataacaacaacttcaattcttcctcaaaccctaatctcacttcctccacatcagatcatcatcatcctcacccttctcacctctctctctttcaagctttctccacttctccagtcgaacggcaagatgggtcaccgggagtttcacccagcgatgccacggcggttctttccgtataccccggcggtcctaaacttgagaacttcctcggcggaggagcctcaacgacgacaacaagaccaatgcaacaagtgcaatctcttggcggcgttgtcttctcttccgacctacagccaccgcttcatcctccgtccgccgccgagatctacgactctgagctcaagtcaatagccgctagcttcctaggaaactactccggtggacactcgtcggaggtctctagcgtacataaacaacaaccgaatcctctagctgtctcagaggcttcgcctactccgaagaagaacgtagagagttttggacaacgtacctcgatttatagaggagtcacaagacatagatggactggaagatacgaagctcatctatgggataatagttgccgaagagaaggccaaagcagaaaaggaagacaagtttatttaggtggttatgataaggaagataaagcagctagagcttacgaccttgcagctcttaagtattggggtcctacaactacgactaatttcccgatatcaaattacgaatctgaacttgaagaaatgaaacacatgactcgacaagagttcgttgcttctttaagacggaaaagcagtggattctctaggggtgcctccatgtacagaggcgtcactagacatcatcagcatggtcgatggcaggcacgaattggaagagttgcaggcaacaaagacctttatcttggcacatttagcactcaagaggaagctgcagaagcttatgatatagcagcgatcaaattccgcggtctaaatgcagtcaccaatttcgacatcagtcgatatgatgtcaaatcaattgctagctgtaatctccctgtgggtggactaatgcctaaaccttctccagcaaccgcagcggctgacaaaaccgttgatctttctccatccgactctccatctctaaccacaccgtccctcacgttcaatgtggcaacaccggtcaatgaccatggaggaactttttaccacactggtataccaatcaaaccagacccggctgatcattattggtccaacatctttggattccaggcaaacccgaaagcagaaatgcgaccattagcaaactttgggtcggatcttcataacccttctcctggttatgctataatgccggtaatgcaggaaggtgaaaacaactttggtggtagttttgttgggtctgatgggtataacaatcattccgctgcatcgaacccggtctcagcaattccgctgtcctcgacaactacaatgagtaacggtaacgaagggtatggtggaaacataaactggattaataacaacatttcaagttcttaccaaactgcaaaatcaaatctctctgttttgcacacaccggtttttgggttggaatga

SEQ ID NO: 138 - DNA, 1047 bp, Arabidopsis thaliana
atggaggatagcaactctcacccgcaaaatcaaacatcaaaaagaaaaagctctcacccgcaaaagaagcaacgtatggagaatgaaacacgatcggctaagttgttggatcttgatgttcttgactgtccggtttgcttcgagccgctcactattcctacctttcagtgtgatgatggacatatagtttgcaatttttgctttgccaaagtgagtaacaagtgccctggtcctgggtgtgatttacccattggtaataagcgatgcttcgcaatggagagggttctcgaatcagcctttgttccatgtcaaaatactgagtttggctgcacaaaaagtgtctcttatgaaaaagtgtcaagtcacgaaaaggaatgcaactactctcaatgctcttgccctaacctcgaatgcaattacactggctcatataacatcatctacggtcactttatgcgtcgccatctttacaatagtacgatcgtttcctccaaatggggatattccactgttgatgttctaataaacatcaaagaaaaggtttcagttctctgggaatctcgtcagaaacttttgtttgtagttcagtgtttcaaggagcgacatggtgtttatgttactgttagacgcatcgcaccacctgcttcagaattcaagaagttctcgtatcgtctttcgtatagtatcgacggacataatgttacttacgaatcaccagaagtaaagaggcttcttgaagtgaattctcaaatccctgatgacagtttcatgtttgtccctaactgtttactgcatggtgaaatgttggagttgaagcttggcatcaagaagttgaaacaaacttgtataatccaaaagctttctggtttggttcccggttcggttttgtacatagtaggatttttaataaagcctgctaatgaggttcagcaagttaccattgctcaggaaactgttatggaggatcctccaacgtctctgtttaagaattcagtaccaattcgagaggatcaaattcagaacgctatcacaaattccattcgctaa

SEQ ID NO: 139 - DNA, 1300 bp, Arabidopsis thaliana
tgctctttatacattttcaaaatgtaaagatccacaacaagaggaatgggtttgttcttagtcctattccccgaccacaacaacaacgactcttcttcttattattctccggcaaaaactaccttccgctccaaattatcctctcgtcttctcctctccaaggctgaatccacaatctcaagctgcatcatcctcctcttcctcactctcttcctcttcactctctctacattcgaagaaccttcctctcgttttcccgccatttcttctcctcactggcgatttctcctcaaccgcaacatcatctctcgtcgtttcgctctacaaggaatgggtactctgtttctaagaggaaccaagagcatgcacgatttaatcattgctcatatcgcttccgttacaacggagaacgatctccgtctctttatacggttgcttcaccgctccggagttacttcaaaatccgacgtcgttttactcttcaattcaccttcatccactacaagattcaccgagttgatcgaacaagagaacaactcgttcttaaagctcgttcatgttcatcggaatgattcgatgacatcatcatcatcatcatctgagcatgttatttgggggaagaagagtcgtcatcgagctaattataactcgaacgagctgactcatggctcgatagttggtttcgacgtaactgagttggatcctgaaaactctttatccgggtttatggatcaagttccgttaagcttgaggagatgggcttgttacccaatgcttcttggtcgagtacgacgcagtttcaaacacgttatgcttgttgacgctaaaacttcatttttcatcggtgacccgtttacccggattcgtaaccggagccccgactcagtcctcttcttcttctcaaaacacaagaacgcctccgaggttaatccggagattttgatcggtggagctaaaggaatcaggagattgtcgagctccatgcatactgagattgtgagagcgacgatgatgaagaagaactcggttacggaagtaacggaatcggttgtgttgagtcaactcgtcgggaatgttcatatgacgaagaactttcaagtggttttaagtgagtcagtggtgccggaagcgaattagttattatgaaacgtatttgttcatgtttatactgttattatggcgataattatgaaacgtatttgttcatgtgaattggattcttctgtctacgataattaatgttggcaatatttttttaaaaaattacaaaaaatatataaaatttttgtattcatttgac

SEQ ID NO: 140 - DNA, 1046 bp, Arabidopsis thaliana
ctcaaaacaaaaattgagagaaaaatatagcattagatacgggaaggtccacgtaagacccgtactctactttgattctctcaatctccttcaatttttttctagattttttttgtgatcaatctttgatctaagaagatgaagcgtgagtatttagattatacacttgtgcctttagggcttgctttgatggtcttttatcatctatggcttctctaccgtatcatccaccgtccttcttcgactgttgttggccttaacgccttcaatcgccgcctttgggtccaagccatgatggaggactcatccaaaaacggcgttttagcggttcaaacgctaaggaacaacataatggcatcaactctattagcatcaaccgcaataatgttatgttcactaatcgcggtactaatgactagcgctacaggagagcgatcagtctggtttgtgtttggagacaaaagcgaccgagccttctcgctcaagttcttcgcaatcctcgtgtgtttcctagtcgcgtttctcctcaatgtccaatcaattcgttattacagccatgcaagcatccttatcaatgtcccctttaaacagctcatggctgtttcttcaggtggtcgtggtaatggtagtcttatgataaaccaagattatgtggctgcaacggttaaccgtgggagttacttctggtcgttaggactacgagcgttctacttctcctcgcctttattcctatggatctttggtcccatcccaatgttcataacttgttgcgttcttgtttgttcgttgtacttccttgatttaacgtttgactcgatgaaatgtagcgttggagccgcagacgcggaggagcccgagattagaagcttagctcagaatgtttagtagtttttttttaatttgataatggttaggggttcagatatattgaagagagttttgttcaatggaacatacaaatcttgtaagttgtattgattcaggttcaatggtagttgaaccgtgtcaaagtgtcactctgtaaccaagtgaagaaatttgttgtc

SEQ ID NO: 141 - DNA, 1035 bp, Arabidopsis thaliana
aagaaaggcaatggagaataagaaccagaagcggtttgtgctcatccatggggtgtgccacggggcatggacttgggacaaggtgaaaacgcagctggaggttgcaggtcactgtgtgacggcagtggatcttgctgcatcaggtataaacatgaccaaagtggaagagattcagactctgaacgattactgcaaaccattgcttgagtttctgagctcgcttggctcagatgacggtaaggtgattgttgttgctcatagcatgggaggaatatccgctgcacttgctgctgacagcttcgcttgtaagattgccgctattgtctttttgacagctttcatgcccgacacaataaacccacctgcttatgtttacgaaaagctgctcagaagcattccacaagaggaatggttggacaccacgtgtgtgaactacgggaaacctgattttcctctacagtatactcttttgggaccaaagtttatggccaagaaaatgtatcaaaactctccagttcaagatcttgaagtggtgaagacattagtgagggaaaacccgttagttacaaacaatctggcagggacaagaagctttagtgaggaagggtacggatccgttacacgtatatatattgtatgcagagaggatcttgtggaagtcgaagattaccagcgttggatgattagcaactttccaccaaaagaagtaatggagatcaaatgtgcagatcatatgccaatgttctccaagcctcaagaagtttgtgctcttctcctggagattgcaaataaatattgcaaaaattaaccaatttcagcttccaccaataaataatacgccataagagaatacatctatatgtatgagaactaagcaaatgataatgcttatataataaagtttcgtgagaaaactgtattacacagagaagtagttacaaggcctcttggtttcaaatgtaggatcatagcatcataatagagagaactgcaatgtctgcattgcgaagcatcactataaccaatgttgcagag

SEQ ID NO: 142 - DNA, 948 bp, Arabidopsis thaliana
aagaaaggcaatggagaataagaaccagaagcggtttgtgctcatccatggggtgtgccacggggcatggacttgggacaaggtgaaaacgcagctggaggttgcaggtcactgtgtgacggcagtggatcttgctgcatcagatgacggtaaggtgattgttgttgctcatagcatgggaggaatatccgctgcacttgctgctgacagcttcgcttgtaagattgccgctattgtctttttgacagctttcatgcccgacacaataaacccacctgcttatgtttacgaaaagctgctcagaagcattccacaagaggaatggttggacaccacgtgtgtgaactacgggaaacctgattttcctctacagtatactcttttgggaccaaagtttatggccaagaaaatgtatcaaaactctccagttcaagatcttgaagtggtgaagacattagtgagggaaaacccgttagttacaaacaatctggcagggacaagaagctttagtgaggaagggtacggatccgttacacgtatatatattgtatgcagagaggatcttgtggaagtcgaagattaccagcgttggatgattagcaactttccaccaaaagaagtaatggagatcaaatgtgcagatcatatgccaatgttctccaagcctcaagaagtttgtgctcttctcctggagattgcaaataaatattgcaaaaattaaccaatttcagcttccaccaataaataatacgccataagagaatacatctatatgtatgagaactaagcaaatgataatgcttatataataaagtttcgtgagaaaactgtattacacagagaagtagttacaaggcctcttggtttcaaatgtaggatcatagcatcataatagagagaactgcaatgtctgcattgcgaagcatcactataaccaatgttgcagag

SEQ ID NO: 143 - DNA, 2099 bp, Arabidopsis thaliana
cacaaaagccctcttttttgttatccccttctctctctgaaactagggtttctatttctctgagtgatgtgaaatgctcgtgtaaacggaaacgatgcagaagattctgtgcaaaagtaccacttcttcaacccctgttctctctacgccggtgaactctctcgccgccggttttatctctctagggtttaagacccccgttaaaaatctccctccttgttctactactaaacctctctccacttgtttcttctctacttccgctatgccgaccacaacggcttctgtttcttcaggcggtgttggtttctctgcttatctacagaggactgttcataaaccggcaccggcgtctgttcggttctcaacagctggttaccggacttgccggtgttcaattgacggtacgaaccgggcttgggttggtcgaactgggtcttggcgtgcgttgttttgttcagactctactggtggtttaaccccggttaatgctactgctggagcagtggttgaaagcgaggaagagtctgacggagaagatgaagacgaggagaaagatgagaagcctgtgaggatgaaccgtagaaaccggagctctagtggaagtggtgagtttgttggtaatccagatttgctgaagattcctggagttggtttaaggaatcagagaaagcttgttgataatgggattggtgatgttgcagagctcaagaagctttataaggataagttttggaaggctagtcagaagatggttgattatcttaggagctctgttgggattatacatagaaaccatgcggagagtataacaacgtttattaaagagagtgtggatgatgagcttaaggattctggccctgaacctaatctaaatgtgaagaaacgtttgacgttttgtgttgaagggaacatcagtgttggtaaatcaacttttcttcagaggatagcgaatgagactgttgagttacaagaccttgttgagattgttcctgagccagttgataagtggcaagatgttggacctgaccatttcaatatattggatgctttctactctgagcctcagaggtatgcttatactttccagaactatgtgtttgtcactcggctgatgcaggagaaagagtctgcttctggggttaaacctctcaggttgatggaaaggagtgtcttcagtgaccgaatggtgtttgtgcgtgcggttcatgaagcgaaatggatgaatgagatggagatcagcatttacgactcttggtttgatccggttgtctcttctttacctggacttgttcctgatgggtttatatacttaagggcgagtccagacacttgccacaagcgaatgatgctcaggaaacgagcagaagaaggcggagtctctctgaaatacctccaagatttgcacgagaagcacgagagctggctgcttccctttgagagcggaaaccatggtgtattgtctgttagtagaccatctttacacatggacaactctctgcatcctgatataaaggaccgtgtcttttacttggaaggaaatcatatgcattctagtatccagaaggtccctgctctggttttggactgtgaacccaatatcgacttcagccgggatattgaagcaaagacacagtatgcacgccaggtcgctgagttctttgagtttgtgaagaagaagcaagaaacatctacagagaagagcaacagtcagtcgccggtactgctaccacatcagaatggaggtctctggatgggaccagcaggcaatcatgtcccgggattagatctcccgcctctagatctcaagtcactcctcactagaccgtctgcgtgactgtccattcactgactctgtttttgttggctccaagggagcgtgtcaggttattgaatgtcaatagtttcgatcggcttttatatcgtttatttaggaaaaaaacgtttgctgccgcttttgtccatcttagatgtagaaacaaaacatggtcgtgccaccgtttagtttaacccttttgtataaaagtttggtctctggataatttgtttcttgaaatcttgttggtcgtctaaaatttcagttcagttcatgtttctgc

SEQ ID NO: 144 - DNA, 1003 bp, Arabidopsis thaliana
atgaagatccaaatactctgtttcaccactctgttcttagctatcttcacctctcaagtcaccactgcttacaaattcaaattcgattactttggtaacggcaccgatccaatatcattccatggagacgctgagtatggtcctgacactgatggcaagagccggtccggagccatcgcattgactcgagacaacattcctttctctcatggtcgagccattttcaccactccaatcactttcaagcctaatgcttcagctctttacccttttaaaacctctttcactttctccattactcctaaaacaaaccctaatcaaggtcatggccttgctttcatcgtcgtcccaagtaaccaaaacgacgccggttccggtttaggctatctcagtcttctgaaccgaaccaataacggtaatcctaataaccacctctttgccgttgagttcgatgtctttcaagacaaatctcttggcgacatgaacgataaccatgtcggaatcgatattaattcggttgattcggtggtttctgtgaaatccggttattgggttatgacaagaagcggttggttatttaaggatttgaagctaagtagtggagatagatacaaggcttggattgagtacaacaacaattataaagtagtctctgttacgattggtttagcgcatttgaagaaaccgaaccggccattgattgaagcaaaattcgatctttccaaggtcatacacgaggtaatgtataccggttttgctggttcgatgggtcgtggtgtcgagcgtcacgagatttgggactggactttccagaattaagaaaacaggtttggtttggttcgagatcatcggttttcttttggtttatgtttctggtttaccctggtgtgccttcagcttgtgataattgaagtgaaataattgctcattttatgtcttaccgacaatttgatgtattattgttgtcagattagtagaaatcaaggacgtttcgttcctaatc

SEQ ID NO: 145 - DNA, 1363 bp, Arabidopsis thaliana
ctctcggtgtccttgtatacagtacttcagttttccgatctctttcagattctgttgccaaacttcatataaacttagtgagcggaactggatttggggagaatggcttcttctttagctcaatctagaatctcgaatctccagaatcatctttcacctcttgaagcaaacaacaagctcaggagtctggtcaagatttctccccaagtatctgaagccttgtctaatggacgtgctgttgtcgctcttgagtcaaccattatctcccatgggatgccttaccctcaaaatctgcaaacagcaaaagaggtggagtcaattgtgagagaaaatggagcaatccctgcaacaattgctatccttaatggagtaccttgcataggtctgagcgaggaagaactagaacgtcttgcatctctcggaaaaagtgtccaaaagacagcgggaagggacatagcaaatgttgtggctacaagaggaaacggtgcaactacagtctctgcaacgttgtttttcgcttcaatggttggcatccaagtttttgtgacgggcgggataggtggtgtccatagacatgccaaccattcgatggacatatcatctgatcttactgcacttgggaggactccaatagcagtgatatcagcaggcgttaaatcaatacttgatattccaaagactcttgaatatttggaaactcaagaagtgtatgttgctgcatacaagagcgatgagtttccagcatttttcacagaaaaaagtggctgtaaggcaccttcccgtgtaaatagccctgaagactgtgctagagtaatagatgcaaacatgaagctaaaccgtcaggcggggattctatttgccattccaattccgaaacaccattcagccgctggaaatcttatcgaatcagcaacacagcgtgctcttacagaagcaagggaacaaaacgttactggaaatgcagaaactccattcttacttgcacgggtaaatgagttaaccggaggcacatcacttgcagcaaacattgcgcttgtgaaaaacaatgcccttatcggttctcagattgcagtagccctttctcagctgatgtgagcttccttatcaatcccagactcaagctcaagcgcaagttattcaggttcatgattcaggacagatcaaagatgttttggattggtagttatcaatttatattggttatcaaagatttttctttagctaaagaaactcgttaacttattatcacatgttatatattagtcattagatttatatcatgtggtacccttaaagattaaactattgaaattttaatttatatcacaaaggatctcaaggaaagatctgatctcaaggatgt

SEQ ID NO: 146 - DNA, 2063 bp, Arabidopsis thaliana
gcttaccgaaaacatattttgtaaaatacaaaattcttatatccgaatgtaactaatttgagaaagacggtctctatacgtatataaaatatatgtatatatgcctctctattctttgatgaacttcagtcagggtaattaatttactaaaactcttccaaaatgtcacattccttcttcaatttattcctaatctctcttttcctctacaacaattgcattgcgcatcactatacattcacggttagggaagttccatatacgaaactgtgtagcacgaaggcgattttaaccgttaatagtcagtttcctggaccgattataaaggttcacaaaggagacactatttatgttaacgttcaaaaccgagctagtgaaaacatcacaatgcattggcatggtgtagagcagccgagaaatccgtggtcagatggtcctgaatacatcacacaatgcccgattcgacccgggtcagattttttgtacaaagtcatattttccatcgaagacacgactgtttggtggcacgcgcatagctcttggacacgtgcaactgtacacggtcttattttcgtatatcctcgccccccgcaaatcctcccttttccaaaggcagaccatgaagtccccataattttgggtgagtggtggaagagggatgtgagagaggtcgttgaggagttcgtaaggacaggaggggctcctaatgtgtccgatgctttgaccatcaatggacatcctggtttcttgtatccttgctctaaatcagatacatttcatctcacggtagagaaggggaaaacctaccgcattcggatggtaaatgccgcaatgaacctacctctctttttcgcaatcgcgaaccacagcctcaccgtagtctcggccgatggacactacatcaaacctataaaggctacttatatcactatatcccctggcgaaacactagacatgttattacacgctgaccaagaccccgaacgcacttattacatggctgccagagcttaccaaagcggaaatatcgatttcaacaactccactaccataggaatcttaagttacacctcttcatgcaaagctaaaacatcatcgttttcaggatattacccaacccttcctttttacaatgacacctcagcagcttttggattctttaccaagatcaaatgcttattctccggtcaagttcctgtccaaatctctcgtaggataatcacgacggtttcaataaatcttcgcatgtgtcctcaaaactcgtgcgaaggtccaaatgggtcgagattagcagcgagtatgaacaacatatcgtttgtcacaccaagtcacgtggacatactaaaagcttattactatcacattaaaggcgtttatggaacgcggtttccggagtttccaccgttgatttttaatttcaccgcagaaaatcagccattgtttttggaaactccgagactcgcaaccgaggtaaaggtgattgagttcggtcaagtggttgagcttgttattcaagggactagtttggttggtggtggactcgatcatcctatgcatctccatggttttagcttctatgtggttggagtagggttcgggaactataacataagtgaagaagatccgtcgtcgagatataatctctacgatccaccgtataaaaatacaatgaccgtgcctaggaatggttggatcgctatcagattcgtagctgataatcccggggtttggttcatgcactgtcacttggatagacatcaaacgtggggtatgaatgttgtgttcattgttaagaatggtagagagccaaatcagcagattctgcctccaccagatgatttgccgccttgctatgaataattaaatgttaccaaatgcttttatctattcaaactggtattcaattgttaccaatttgggcatatttaaatcatgatcatattgtatttcatttatgtaataaattattttactaaaagagaattcttaattttcttgtcgtaaaaatataatttacggtggtattattaaggataaacaatgtattaatcttgtgtcataac

SEQ ID NO: 147 - DNA, 429 bp, Arabidopsis thaliana
atggatgtgaagaaagatgagaacagtatcttagaaaacatgaaacaagagattaatcatagtctaaaagaagaagcacaagaagaagaagagattctaaagaagagaatctcaagccaccctttgtatgggcttcttcttcactcacatctcaattgtttaaaggtgtgttccggcgactttgactcaccggagatcatgaacacggctgatgatcttgccctatccaaactctctctccaccctgactcttcctccgaagctacctcttcagaacttgatcaattcatggttcttttttttttttctccctgccaaaacatatttacacaacaaaaaacaacttttcacgttcttttattttttcctttgcaaattaatttgactttcaagtattctaagtttattttgccaagaaaaaaacagtag

SEQ ID NO: 148 - DNA, 1658 bp, Arabidopsis thaliana
acttcacgattatcactcaccactttccgtttcaactttcaaactctctctcacaagccatgcaagacgcggagagaaccaccaatgatccggtagacagaattgagaaagtgacatggagagatctgcaagacggatctttcaccgcagaactcaagaggcttatctgctttgcggctcctatggctgccgtggttatcattcagttcatgatacagataatctcaatggtgatggtgggtcacctcggtagactctccctcgctagcgcttccttcgcagtctccttctgtaacgtcactggcttcagcttcattataggattgtcatgtgccttagatactttgagtggtcaagcttatggagctaagctatatcggaaactaggtgttcaggcttacacagctatgttctgtcttactttagtgtgtctccctctctctctcctatggttcaacatgggaaagcttattgtgatccttggccaagaccctgctattgctcacgaagctggtagatatgccgcttggctcatcccaggactgttcgcttacgccgttcttcagccgctcattcgctacttcaaaaaccagagcttgatcacacctctcctcgtcacctcttctgttgtgttttgtatccacgttcctctctgctggcttttggtttataagtcagggcttggtcatattggaggagccttggctctcagcttgtcatactggctctatgccattttccttggatctttcatgtactactcctctgcctgttctgagacacgcgcgccgcttaccatggagatattcgagggcgttagagagtttatcaaatatgctcttccttctgcggctatgctttgcctggagtggtggtcatatgaactcataatattactttctggtctgttacccaacccacagctggagacttctgtgctctctatctgtttcgaaacactttcaataacttattcaataccactagcgatcgcggctgcagcaagcacaagaatctcaaatgagttaggagctggaaactctcgagcagcacatattgtggtctatgcggcaatgtctcttgcagtaatggatgcattgatggtgagtatgtctctattagccggcaggcatgttttcggccatgttttcagcagtgacaagaaaaccatcgaatatgttgcaaagatggctccgttggtctctatttctatcatactggacagtttacaaggggttctctcaggtgttgcaagcggatgcgggtggcagcatataggggcttacataaacttcggagctttctatctctgggggatacccattgcagcatctttagccttctgggttcatctgaaaggtgttggcctttggattggaatactagccggtgcagttctgcagactcttctgctggctcttgtcacaggctgcacaaactggaaaacccaggcccgtgaagcgagggagcgaatggctgtggcccatgaatcagaacttacagagtcagaacttcccatctaagattacagggacacagatgttcctcctattttaccatttttgtagcagccaaatcgttatatgttactgctggactagtggttgccgtgaataattggtcttttcttttgtaatattagcagccctcagcaatcg

SEQ ID NO: 149 - DNA, 1432 bp, Arabidopsis thaliana
aaaataaatttgtattaaccactctttaaattcatcctctggatctgttgtactcgtatagagaaaaaatggcgtatcctgagagatctctcattgttgatcctagaagtggtttctgcaaatcaaactctacattctatagcaagcgccaaccattaagtctcccgccaaatctttcgcgtgacgtcaccacattcatctcctctcagccacaccgtggcaaaaccgcctttatcgacgctgccacaggccagtgcttaaccttctccgatctctggagagccgtcgatcgcgtcgccgactgtctatatcatgaagtcggaatacgaagaggcgacgtcgtcctcatcctttctccaaactccatcttcattcccgttgtttgcctctccgtcatgtctctcggcgccgttttcaccaccgccaacactctcaatacttccggtgaaatctccaaacagattgccgacagtaatccaactctcgtcttcactacgcgccagctggcaccaaaactccccgtcgctatctccgtcgttctcaccgacgacgaagtttaccaggagctcactagcgcaatcagagtcgttgggattttaagcgagatggtgaagaaagaaccgagtgggcaacgagtcagggaccgagtcaaccaggacgacacggcgatgatgctttactcgtcgggaaccacgggaccgagcaaaggagtgatctcgtctcaccggaatttaacagctcacgtggctagattcatatcggataatttgaaacgagacgatattttcatctgtaccgtcccgatgttccacacctacggtttattgaccttcgctatgggcaccgtagcattgggttcaacggtggtgatcctccggagatttcagctccacgatatgatggatgcggtggagaagcaccgagccacagctctggctttggcgccacctgttttggtagctatgattaacgacgcagatctgatcaaggctaagtacgatctgagctcactgaaaacggtgaggtgtggtggagcgccgttgagcaaggaggtgacggaagggtttctagagaaatatccgacggttgatatactgcaggggtatgctttgacggaatccaacggcggaggggctttcacgaattcagcggaggagagccggagatatggcacggcggggacgttgacgtctgatgtggaggcgaggatcgtggatccgaatacgggtcggttcatgggaattaaccaaacgggagagctctggctcaagggcccttctatttctaaaggtaaaatcactagatagtttttgctttgcttgcgatagaagtaataacttgatcatttttttggtcaaaggcaaaaacttaaccatttcaaatcaatgtataagataaagataaattaaattgttattgagatcaagtttat

SEQ ID NO: 150 - DNA, 812 bp, Arabidopsis thaliana
atcttagggtttcgcgagatctcactctcactgagatagcttagcaatggagcagtcagaagagggtcaacagcaacagcaacagggagtgatggattatgtacctcctcatgcttatcagagtgggccagtaaatgcagcttcccatatggcattccaacaagctcaccacttccaccaccaccatcagcagcaacaacagcagcagcttcagatgttctgggctaaccaaatgcaagagatcgagcataccactgatttcaagaaccacacccttcccctagcccgcatcaagaagatcatgaaagctgatgaagatgtgaggatgatctctgcggaggctcctgtgatttttgccaaggcctgtgagatgttcattttggagctcactctacgtgcttggatccacaccgaggagaacaagaggaggaccttgcagaagaacgacatcgccgctgccatttccaggaccgacgtgtttgatttccttgtggacataatcccgagggacgagctgaaagaagaaggtttaggcgtgaccaaagggaccataccatcggtggtgggttccccgccatactattacttgcaacaacaggggatgatgcaacactggccccaggagcaacaccctgatgagtcttaaaacttttcccctttcgtttgtttggttgtatcgtagtaaggtagctctgctctgctgggaaccatttctattgtgttctgtaatgacatgttagtatatccccagtctatatctatggcaatgcagtttctgttctcatgtgcattaaataataacaagaatgata

SEQ ID NO: 151 - DNA, 696 bp, Arabidopsis thaliana
acaccaaaatcttaaaaataaattataaaccaaaaacaatgaatctcgccataaagtttcatgtgatggtacttttgctcattgtaattggagatgtttgtgccaatgtaggcgcaaggccgctagaagaagtttccaaagaacttatggataagaaggccgtttcgattcctaagacaccgttaccgttaccaccaccattaccaacattaccgccagcgcagttaccaggtttacccactccgccaaagatgtctaatggtgacactggaggagttgatgcgaacgcagatggtagactacccaaagatgctccagcgggttcccatggtgccacagccagaggatatcgttccggaggtggcaggagtgatgcgtcgggcagcactgacccttggccttgagcgtgaggtgatgatgttcaattgttcattgctcaaacctatataataagataataatactctacaaacgcacggtctcttttctgttcataaataaaactagagattgtcccctttaataataagaaatccctaataataatcatgaaatgctactttctatgtgtaatatataaaataaatgtaataatttactacggctttatcttattgaataatatatgtatgagtgattatggtgtccgtctgactgatcgataaccaaataatatacaaccatgtttcaatgatc

SEQ ID NO: 152 - DNA, 929 bp, Arabidopsis thaliana
ctcaaacccaaaacacattttgttttttgtttcccatctaaaatgcgtatgagttgtaacggatgtcgagttctacgaaaaggctgcagtgaaaactgtagcataagaccttgtcttcaatggatcaaatccgctgaatctcaagccaacgccaccgtcttcctcgccaagttttatggccgtgcggggctcatgaacctcctcaacaccggtcctgaccacctccgtcctgcgatatttagatcattgttgtacgaagcatgcgggaggattgtgaatccgatatacggatccgtggggttattgtggtcaggaaactggcatctttgtcaagcggccgttgaggcagtaatgagaggctcacccgtgactccgatcgcatgcgacgcagcggttactggtcaagcacctccttttaacaacaagctttgcgacataagacacgtgtcaagcagggacgagaacgttaagagacggagccgtggtgcatgcaaggaagagagaaacgtgaggtctttgagtcatgagtcgtcactgagtcacgagtcaccggtgtcttctgaggagacgacgacggaggaaccaaagacttggatcgggcttgagctgactttggggttggagcctttagcacgtggaaatcacgtggtggtaccgatgaagaaaagaaagttagagaggtgtggcacgtctgaggatgaggacacgtgtaagattgagcttggactggtgtgcagtgagtgaatggttctttttttgtggctggtcttaattacaagttttggtgttgagttttaggtgtacaaatagagattaacgaatctctcttttttctctttttgagttttatgttttgttttgttttcttttgcatgttcggtgttcttcataaatatgtatgatgaatgataaagaggtcttaacttaac

SEQ ID NO: 153 - DNA, 2241 bp, Arabidopsis thaliana
actattcactctccgaccaacgaaaaagaaacaaacaaaacattaaaatctctctttctctctatagcattgttatagctagttagagagacaaaactaaaaacaaatggaactggagggctcgagtagtggccggaggcagctgccgtcaaagttggagatgagccgtggagcgtatttggcgtgggaagacttgacggtggtaatacccaatttcagtgatggtccaaccagaaggttgctccaaaggctaaacggttatgcagaaccgggtcggatcatggctataatgggtccttccggatccggaaagtccactcttcttgactctcttgcaggtagactcgcaagaaacgtggtcatgaccggtaatcttctactgaacggcaagaaagctagattagactacggtctcgtagcatatgtgacacaagaggacgtattgttggggacactaacagtgagggagacaataacatactcagctcacttgagacttccaagtgatatgtctaaagaggaagtgagtgacatcgtggaaggcacaatcatggagcttggtcttcaagactgttcagacagagtcattggaaactggcacgccagaggagttagtggcggtgagaggaaacgtgtcagcattgctttggagatcctcactcgtcctcaaatcctttttctcgacgaacccactagtggtttggacagtgcttctgcgtttttcgttattcaggcgcttaggaacattgcacgcgatggcagaaccgtaatctcctcggttcatcagcccagcagcgaggtttttgcgctgttcgatgatcttttcttgctttcgagtggtgagtctgtctactttggtgaagccaagtctgctgttgagttctttgcagaatcgggtttcccgtgcccgaagaagaggaatccttccgatcattttctgcgatgtataaactcggactttgatacagtcacagctacactcaaaggatctcagagaattcaggaaacaccagctacatcagatcctctaatgaatctagcaacatctgtgatcaaagcaaggcttgttgagaattacaagcgttcaaagtatgcgaaatccgcaaaatctaggattcgagaactatctaacatcgaagggctcgagatggaaataagaaaaggaagtgaagcaacctggtggaaacaacttaggacattaacagcaagatcattcataaacatgtgtcgtgatgtcggttactattggacacgaataataagctacattgttgtttctataagcgtaggaaccatcttctacgacgttggctatagctacacatcaatcttagcccgtgtttcttgcggcggattcatcactggtttcatgactttcatgtccattggaggcttcccttctttcctcgaagaaatgaaggtgttctataaggagaggctaagtggatactacggcgtttcggtttatatcctctcgaattacatctcttctttccctttcttggttgcgatttcggttatcacaggaactattacttacaacttggtgaagtttcgtcccgggttctcgcattacgctttcttctgtctcaacatcttcttctcagtttccgtgatagagagtctcatgatggttgtggcttctgttgttccaaacttcttgatgggtcttatcactggagctggcctcattggaatcatcatgatgacttctggattcttccgtcttcttcctgatcttcccaaaatcttttggcgttacccggtttcttacataagctacggttcttgggctatccagggagggtacaagaatgactttctagggctagagttcgagccattgttcccgggtgagccgaaaatgacaggagaggaagtgatagagaaggtctttggagtgaaggtgacatattcaaaatggtgggacttagctgcggtagtagcaatccttgtgtgttacaggcttctcttcttcgtggttctaaagctgagggagagagcaggacctgctttgaaggcgattcaggcgaaaagaacgatgaggaatcttgataggagaccttcttttaagagaatgccttctctgtctctttcactgtcgtcaatgtcttcaaggagacaccaacctctccgctcactttcttctcaagaaggccttaactctcctatccactactaaaagacttaatataatgtatgcatgtgttctgaagctttcatcaagatctcatcttaatc

SEQ ID NO: 154 - DNA, 418 bp, Arabidopsis thaliana
atggcaatgaggttctcatcacttactaaaatcgtgcttctctctgcagctatgttgcttttggtccacgcaagtgctcgcactttacagcaaactcagactctgcctctccaaggaggaggagctgctcctaccaaagatgagcctcatatggttaatgcccctcttgaggaccagaagaacttcatctacggcggtggaattggcggtgttgccggagttggtggattcatggggatgccaggtggtggaagtggtggctctggcatgactttcccactcccgagtgggacgccgcttcttggtggggctggtgggcttggtggtttgggtggtgcaatggggttccctggtggactcggtggtggacctagtggtggtggtgttccaagttcaagcggtggttctccttaagaca

SEQ ID NO: 155 - DNA, 1054 bp, Arabidopsis thaliana
ataatcgctgagagtccaaatgaatacaaaaacggtgaagtcaatggcgggcattgttctctctcaaatctcacttgttgcgctgtttcctctatgtatttgttatcaaacacatcaaagcacgagctctgtagcctctctatcccctcagttttacgagaactcgtgcccaaacgcacaagccatcgttcaatcttacgtcgccaatgcatacttcaatgaccctcgcatggctgcctcaattcttaggctccatttccacgactgtttcgtcaatggatgtgatgcttccgtactattggacagtagtggaaccatggaaagcgagaaacgatcaaatgcaaatcgagactctgctcgagggttcgaagtcattgacgagatcaagtctgccttggaaaatgaatgtcctgaaacagtttcttgcgccgatctattggctctcgttgctagagactctattgttatttgtggtggacctagttgggaagtatatcttggaagaagagatgcaagagaagcaagcttgattggttccatggaaaacattccttctcccgagtccacgttacaaacaattctcactatgttcaactttcaaggacttgatctcaccgatcttgttgccctcttagggagtcacacgataggaaactcaaggtgtattggtttccgacaaaggttatacaaccatactggaaacaacgatcccgaccagactttgaatcaagactacgcctctatgttgcagcagggatgtccgatttcgggcaacgaccagaacctctttaatcttgactatgtgacgccgactaagtttgacaattactactacaagaatcttgtgaactttagaggactcttgagttctgatgagatattgttcacgcaaagcatagagactatggagatggtcaagtattacgcggagaatgagggagcgttctttgagcagtttgcgaagtcgatggtgaagatggggaacatctcaccgttgacggggacggatggtgagatccggaggatatgccggagggttaaccatgatgtttga

SEQ ID NO: 156 - DNA, 948 bp, Arabidopsis thaliana
aaaagcatcataatctcgatgagttaaatccatgtatctcaaaaccctaatcaccacttagctagtaaaaggaaaggaaaataaaaaggacttgtgtggtagaaaaggaagatgagcagtagcggaaaccctagcagcagcagcggtggaggaggaggaccgtgcggcgcgtgcaagttcttgagaaggaagtgtgtcgctggctgcatcttcgctccttactttgactccgagcaaggagcggcgcacttcgcggcggttcacaaggtgttcggagcgagcaacgtctccaaactcctccaccatgttcccgagcataaacgaccagacgccgtcgtttcaatctgctttgaggctcaagctcgtctcagagaccctatctacggctgcgtctctcacatcgtctctcttcagcaacaggtggtaagtttgcaaactgagctttcatatctacaagcacacttagcaactctagagctgccacaacctcaaccaccacaggttccggtgtcatcttcaggatctctacaggctctttccataacggacctcccaacaatatcaccgtcggtgtacgacctctcctccatcttcgagccggtcatgtcctccacttgggccatgcagcaacaaccacgaccgtctgatcatctcttcggcgtcccgtcatcgtccaatatgggcggaggcggtgagctccaagcactggcgcgtgagtttattcacggtgggcaaatgccagctcagccatcgccgggaaccagtggttctgcctcgtcagtgataaaacgagaatgaagttatttttatcgtatgtttgtttatttggaccgtaagagatctatagttagccatatgtttctccttgtaatatatatacttggtcgaattcgtatttaaattgttgtctagaatgttaatataagaactatatgatttacattgatt

SEQ ID NO: 157 - DNA, 742 bp, Arabidopsis thaliana
atgtcttacagtgacccaaaccaaaacccgattccagaaacttacgctccatcaaactcaactgaatcagagaaactgaaactttaccaagcttttatcttctctgttccaatctgtttcacattcatcgttctcttcgttctttacgtcatttaccttcgtcgaaacagcaccaccaatgttgattggtcttctcttggcatgcgtggtggtacctttgtccccaccaacaacaatctctcaacggctgaattaggactgagcaaagatattagagagatgcttcctgttgtcatctacaaggagagtttcatagtcaaagattcacaatgttcagtgtgtcttggggactaccaagcagaagagaaactccaacaaatgccatcatgtgggcacacttttcacatggaatgtattgatctatggctcacatcacacacaacatgccctctttgtcgtctctctcttatccccaaaccgtccctagacctgtcccatcaaagcacagagattgtctcttccatagaaaactctaatggaggagaagcttcaactcaaccagattcccagtcagcaaccgaagcaataagtcacaccgatgatgtcgaagaaggtaaccgagatagtcaagaggtctctaaggagacggaagagaatgaccgaaacagcgtagggacatctgatggttgttgtacttgtagacttggttaaaaaagcataaaagctttgtcttgcctttaga

SEQ ID NO: 158 - DNA, 843 bp, Arabidopsis thaliana
caaacacacacaaatctctgaagtaaaatgacgttcccttctctttctgtctcatttctcttctttgccttcatattcgttacgcatgcattcgacctcagcatcatccagatgcaacagggaacatgtccgtacacggtggttgtcatgacaagctgtctttctccggagtcgacaagagatcagatcagcattgtttttggcgatgccgacggtaacaaggtgtatgcaccgaaactagggggtttggtaagaggaccagggggtttggggaagtgttcaacgaacacattccaagtcagaggtcaatgtttgaatgaccctatctgctctctctatatcaaccggaatggacccgacggttgggtcccggagtccattgagatctactcagaaggttcaaagtccgttaaattcgatttcagcaagagcgtccctcaactaaacacttggtacggccacaacaactgcaacaccacaggcagaccatcgtctcccgatctgcctccaccacattttccgccagagtttccaccggagacacctaccaccccaccgccgcctccaccaaggccgtctgctgcttcaaggcttggaaatggtgagagtgttttccttgcgtttgccattgcgactgcgattgccgcaatggtgcgttggagttactagcatggtacttgaagagcatgttgttgggttgtatgaggctttttctttccgtcgaatgtttttatttgctttcgttttgcttcagccttttccttgttgtagaaaacataattacttattaagtatgtgcgcatgagttcctgtttagctatgattattaatcagttggtaccg

SEQ ID NO: 159 - DNA, 1017 bp, Arabidopsis thaliana
caacaaacatcaagcatttataatttatataacactcacgagagcctctttctttatctacctcgtctcctaatcacaaacacacacaaatctctgaagtaaaatgacgttcccttctctttctgtctcatttctcttctttgccttcatattcgttacgcatgcattcgacctcagcatcatccaggttcttcttgttttctactttctggctaacaaagtaaccagaaccggttttctcacttgtatatttgtttttttgagaaaatcatgtagatgcaacagggaacatgtccgtacacggtggttgtcatgacaagctgtctttctccggagtcgacaagagatcagatcagcattgtttttggcgatgccgacggtaacaaggtgtatgcaccgaaactagggggtttggtaagaggaccagggggtttggggaagtgttcaacgaacacattccaagtcagaggtcaatgtttgaatgaccctatctgctctctctatatcaaccggaatggacccgacggttgggtcccggagtccattgagatctactcagaaggttcaaagtccgttaaattcgatttcagcaagagcgtccctcaactaaacacttggtacggccacaacaactgcaacaccacaggcagaccatcgtctcccgatctgcctccaccacattttccgccagagtttccaccggagacacctaccaccccaccgccgcctccaccaaggccgtctgctgcttcaaggcttggaaatggtgagagtgttttccttgcgtttgccattgcgactgcgattgccgcaatggtgcgttggagttactagcatggtacttgaagagcatgttgttgggttgtatgaggctttttctttccgtcgaatgtttttatttgctttcgttttgcttcagccttttccttgttgtagaaaacataattacttattaagtatgtgcgcatgagttcctgtttagctatgattattaatcagttggtaccgacatttagt

SEQ ID NO: 160 - DNA, 1085 bp, Arabidopsis thaliana
gagaaatattcagtggtcggagaatggcgtctctcaaaattccagcaaatattcctcttcccgaagaagactccgagcagctccacaaggcattcaaaggatggggaactaatgaagggatgatcatatcaattttggctcatagaaacgcaacgcaacgcagtttcattcgtgccgtttatgctgctaactacaataaggatcttctcaaggaattagacggagagctttctggtgactttgagagagttgtgatgttgtggactcttgatccaacggagagagatgcgtatttggccaatgaatctaccaaattgttcaccaaaaacatttgggtcctagttgaaatcgcttgtactagaccttctcttgagtttttcaagaccaagcaagcataccatgttcgctacaagacctctctcgaggaagatgttgcataccatacatctggaaatatccgaaagctattggttcctcttgtgagcaccttcaggtacgatggaaatgctgatgaggtcaacgtgaagctggctagatccgaagctaagacacttcacaagaagatcactgagaaggcttacactgatgaagatctcatcagaatcttgacaacaaggagcaaagcacagatcaatgcaacactcaatcacttcaaggacaagtttggaagttccattaacaagtttctcaaagaagattcgaacgatgattatgttcaattactcaaaaccgcgatcaaatgcttgacatatccagagaagtactttgagaaggttctacgtcgagccatcaacaggatgggaacagacgagtgggcacttactagagtggtcactacaagagcagaggtcgacctggagcggatcaaagaagaatacttacgcaggaacagtgttcctcttgatcgagccattgctaatgacacttctggtgactacaaggatatgcttctcgcccttcttggacatgaccatgcttgaaacaacatcatcgtttcatagtcttttataagacagttgttatttgtttttcattttctttgaactttggtccttagtttttacattttactgcaacaacttatt

SEQ ID NO: 161 - DNA, 2078 bp, Arabidopsis thaliana
aataatcagctctcgactattttattgagagtgaaagagaagacaaagatggggagttcaagttacttgctacaaacgttaggccttctgctgctctgctgtaccgtggcagctaataaagtaccactcgcaaacgccaagtataaggacccaaaagagccactgggagtcaggatcaagaacctgatgagccatatgacccttgaagagaaaatcggacagatggttcaggtggaacgtgtcaatgccacaaccgaagtcatgcaaaagtacttcgtcgggagtgtgtttagcggaggagggagtgtgccgaagccatatatcggtcctgaagcttgggtgaacatggtgaatgaggtccaaaagaaagctctttcaacccgcttaggtattcccataatttacgggatcgatgctgttcatggtcacaacaccgtgtacaacgccaccattttcccgcataacgtaggcctcggagtcaccagggatcctggtcttgtgaagagaattggtgaagcaactgcgcttgaagttagagcaacaggaatccaatatgtctttgctccatgcattgcagtgtgtagggaccctagatggggaagatgctatgagagctatagtgaggatcacaaaatagttcaacagatgactgagatcatacctggtttgcaaggtgaccttcccaccggtcaaaagggtgttcctttcgtcgctgggaagaccaaagtcgcagcctgtgctaaacacttcgttggagatggaggtacattgagagggatgaacgcgaacaacacggttattaattcaaatggattgctggggattcacatgccagcttatcacgatgcggtaaacaagggcgttgcaacagttatggtatcctactcgtccataaacgggttgaaaatgcatgctaataagaaacttatcacgggtttcctcaagaacaaactcaagttcaggggcattgtcatctccgactatttaggtgttgatcagatcaacacacctcttggtgctaattattcacactctgtgtatgctgctaccactgcgggactcgatatgttcatgggctcatcaaacttgaccaaattaatcgacgagctaaccagtcaggtgaagcgaaaattcatcccgatgagcagaatcgacgatgctgtaaagagaatcttaagagtcaaattcacaatggggctctttgagaatcccattgctgatcatagcttggccaagaagctcggtagtaaggaacacagggaactggcaagggaagcagtgaggaaatctctcgtgttgttgaagaatggtgaaaacgcagataagccgttgcttcctctgccaaagaaagccaataagatccttgtcgcaggaacacatgctgataacttgggataccaatgtggtggctggacaatcacatggcaaggccttaatggcaacaatctcaccattggaacaacgatcctcgccgcagtgaagaagacggtggatccgaagacgcaagttatctacaatcaaaaccccgacaccaatttcgtcaaggccggtgacttcgattacgcaatcgtggccgtcggagagaaaccgtacgcggagggattcggagacagtacgaacttaaccatatcggaaccaggtccgagcacgatcgggaacgtgtgcgcatcggtgaaatgtgtggtggtggttgtatcgggacgtccggtggtgatgcagatttcgaacatcgatgctctagtggcggcgtggcttccgggaacggaaggtcaaggagtggctgatgttttgttcggagattatggattcaccgggaaattggctcggacgtggtttaagacagtggatcagttgccgatgaacgttggtgacccgcattacgacccgttgtacccgtttggattcgggttgatcactaaaccaaattaacggttttcgattcggtaatttcggttcattaataagattgttgcgccaaaacttaaaatggcaaaatgttaaaataataattcgtatttttctgttgcttatacaattttagagacatgatctcaaattctcaatcactatctccttcg

SEQ ID NO: 162 - DNA, 681 bp, Arabidopsis thaliana
acatcactaccttttctctgctaatttctactatttgtgttggagggatatattataataaaaagaaccaatggcggaccaaacaagaacccatcacgagatgataagccgagacagtacccaagaggcccatccgaaggccaggcagatggtgaaggcagcaaccgctgtcacagccggtggatccctacttgtcctctccggcttaacactcgctggaacagtcatcgcactcacggtggctactcctctcctcgtcatcttcagccccgtcttggttccagcagtggtaaccgttgctctcatcattaccggattccttgcatccggtggctttggaatagccgccattaccgccttctcttggctctacaggcacatgacgggatctggatcggataagatagagaatgctcggatgaaggttggaagcagagtgcaggatactaagtatgggcagcacaacattggagtccaacaccaacaagtttcttaaaattcaaaggctaaaaacgatttccacattaaattgtcatccatcgttagatctcttctctttgtttttattttcaacgtttatgttgtaatgtgtgatatataataacatgcaatgtatgatgtaatcttgttgttgttgtatgagtaatgttttgatccttctatgcgagcggaaatcttcat

SEQ ID NO: 163 - DNA, 736 bp, Arabidopsis thaliana
ataaccaaacatcgagcttgccttagagtttgtctcaagcttctccttttttggtattttgtcttaagcttccttgcttctctttcttcttcttctctactctttctctctatttcaaaccttcgttttctttccttttttgtataaaatcttaaaatcaaccaagacaatggaaatgaaattgctctttacatcggctttcacccaaatgttcggctactcgaaccatatggatcaagccagcaactgccaaagcacccgcaacaaaattataaagatgatgaagaaagaagaattcccaagtggattccaagtccctcttcactaccctaaatactccaagtctgattacgaagttatggatgatctccgccttgacttgctcctcaaacaatatggattctcctttgaaggatctcttgaagacaagagggtttttgcaattgaatcatttctctggcctgatcagctttagatggtctatgttggtgttgaatgatcttatatcgctctccacatgcatatcaatgagcctatactcgagtggttgaatgtttttaaaattatgtcaaattaccatgtatatcaatcacttagtaatgttttagaactatgtcaaatactagtgtgtgttatatttctttgtgtgtggggatgttttgaagtatgcaattcttcacatatatatgtatcatatgagtgcattaataacatctttgatgtcatgtataacact

SEQ ID NO: 164 - DNA, 499 bp, Arabidopsis thaliana
ccttgaccgtacaacaatggcgagaggctcttcccaatcccaacaatcaacctccaccggttcttcaaccgcccggcccggtctggccgctcctcgtggttccgccgccgctactgccggcatgcgtcgccgcaggctcggtggcggtggtggcgtatcctcaggcggcggatctggagttggatcaggatcgagcaacatgctgagattctacacagatgatgctccggggttgaagatctcaccgacggttgttctgatcatgagtctctgtttcatcggcttcgtcactgctcttcacgtctttggaaaactctacctccacaaatccggatcccaagcttagatccggatcaggacctggatcgtttaatcggtgatcgctgtttttttttttttttttagtatgtttccttgtgttttgtttcccttttttagtcttttcgatgagaaccatgtaaatcgctaagcgttgaataaaatacgtcacctttgaaac

SEQ ID NO: 165 - DNA, 1391 bp, Arabidopsis thaliana
ctctcctctcctactttacttatttcattcaaagcaagaaatcgaaaaaggaccccaaacttttttcttccttcatctttctctcctcccatcatcatcaccatgtcctcccataccaatctcccctctcccaaaccagttcctaaaccagatcaccgtatctccggtacatcccaaaccaagaaaccaccgtcttcctccgtagctcaagaccaacaaaacctaaaatgccctcgttgcaactctccaaacacaaagttctgttactacaacaactacagtctctctcaacctcgtcacttctgcaaatcttgtcgccgttactggacacgtggcggtgctctaagaaacgtccccatcggtggtggttgccggaaaaccaaaaaatctatcaaacctaattcctccatgaacacacttccttcgtcttcttcctctcagaggttcttctcatcaatcatggaagattcatccaaattcttccctcctccgacaacaatggattttcagctggccggattatctctcaacaaaatgaacgatcttcaacttttgaataaccaagaagttcttgatcttaggcccatgatgtcctcgggccgagaaaacacacccgttgatgtcgggtcgggtttatccctaatgggttttggagatttcaacaacaaccattcaccgacggggttcacaaccgccggagcaagcgacggaaacttagcttcttctatagagactttgagttgtttaaaccaagatttacactggaggcttcagcaacagaggatggcgatgctttttggtaattctaaggaagaaactgttgtcgtcgagaggccacaacctattctttatcggaatcttgagatcgtaaactcatcatcgccgtcgtcgccgacgaagaaaggagataatcagacagagtggtattttggtaataacagtgataatgaaggagtgattagtaataatgctaatacaggaggaggaggaagtgaatggaacaatggaattcaagcttggactgatcttaatcattataatgcattgccttgaatcttggtaagtttaagaaactatataatctataatttcatataatctatttgctatgtgttgtgatgtaatgccaaaactatttatgtttgtagtttttttttttttttgtattctttttgttgtcgttgttggttactattctagtattttaagtttcaatttgtaaacaaaaaaacaaaattgggggagatattcaagaatggagagagatacttacattatatactggtgatttgtctgtattgaattgaaaggtggaacagaacttactgtgtttaattatcggaaagctcttggtttggtgatgaaatgttcacttaatgacttattggatg

SEQ ID NO: 166 - protein, 342 aa, Arabidopsis thaliana
MDSINKIINFLFPLLTLYALLVFYPTYQRLKSAVSICRNLFSENVAGKVVVITGAASGIGEALAYEYGKRGAYLALVDIRGEPLFHVAALAELYGSPEVLPLVADVSKLQDCERFIRATVLHFGRLDHLVTNAGVAPLYFFADIEDVSKASPAMDINFWGSVYCTFFASPYLKKFRGRIVVIASGCGYIASPRLSFYCASKAAVIAFYETLRTEFGSDIGVTIVAPGIVDSEMSRGKFMTKDGKLVVDKELRDVQMSVLPVESAERCAKAIMRSVCRGDRYLLEPDWIGCVILLKVFCSEATEWVARWLLIARPKFPMMEALSNKILDVAHAFNSFFSFPHY

SEQ ID NO: 167 - protein, 246 aa, Arabidopsis thaliana
MSQTMEEYQSNESEDKRSWIWSKAVSVGKKVLTAGVVVSSAPLLVPSLFVASTLAFLSSVPFCLFLANYACTQKVMSTLLPDTEETGGVGKEDDDESGFDEYSKIGHGEGAAGVGEAALFRGKEEPIPIQVKEDEEMAKESTSLLEKIRDEGRTDKETSERTLQDDKKSGNAKSEEVQEQPEKREAPETRREGETGATKIETSTGKDDEEISSNEPIDQASGAQGTGEEKRKNTTKKKKKTGRAGV

SEQ ID NO: 168 - protein, 506 aa, Arabidopsis thaliana
MAGGGLALDVSSAGNIDAKITAAVVMSCIVAASCGLIFGYDIGISGGVTTMKPFLEKFFPSVLKKASEAKTNVYCVYDSQLLTAFTSSLYVAGLVASLVASRLTAAYGRRTTMILGGFTFLFGALINGLAANIAMLISGRILLGFGVGFTNQAAPVYLSEVAPPRWRGAFNIGFSCFISMGVVAANLINYGTDSHRNGWRISLGLAAVPAAIMTVGCLFISDTPSSLLARGKHDEAHTSLLKLRGVENIADVETELAELVRSSQLAIEARAELFMKTILQRRYRPHLVVAVVIPCFQQLTGITVNAFYAPVLFRSVGFGSGPALIATFILGFVNLGSLLLSTMVIDRFGRRFLFIAGGILMLLCQIAVAVLLAVTVGATGDGEMKKGYAVTVVVLLCIYAAGFGWSWGPLSWLVPSEIFPLKIRPAGQSLSVAVNFAATFALSQTFLATLCDFKYGAFLFYGGWIFTMTIFVIMFLPETKGIPVDSMYQVWEKHWYWQRFTKPTST

SEQ ID NO: 169 - protein, 262 aa, Arabidopsis thaliana
MSGGGNTITAVGGGGGGCGGGGSSGGGGSSGGGGGGPCGACKFLRRKCVPGCIFAPYFDSEQGSAYFAAVHKVFGASNVSKLLLHIPVHRRSDAVVTICYEAQARIRDPIYGCVAHIFALQQQVVNLQAEVSYLQAHLASLELPQPQTRPQPMPQPQPLFFTPPPPLAITDLPASVSPLPSTYDLASIFDQTTSSSAWATQQRRFIDPRHQYGVSSSSSSVAVGLGGENSHDLQALAHELLHRQGSPPPAATDHSPSRTMSR

SEQ ID NO: 170 - protein, 518 aa, Arabidopsis thaliana
MHKDNDSGSGSNPGQVSNYLIVRPHRGGYIDLFRYGVRDDQTSKAKFLEMPDNREWSTITIDEEAEDHRWVIVVSILVRKIIRLLRTPMEFTGFVVDFFLNLFSANGGFFGLLLRLIQAKVVIPERGSVTFVSTIGQLDGRISLYKEWNFVEHLEGIDSVDSGRVKIELGSRGLMDLCVMASKLAYENAKVVENVVDLHWKMNLVEFLDCWNDYQKQMSTQVFVFTDKQKDANLIVISFRGTEPFDADDWGTDFDYSWYEVPNVGKLHMGFLEAMGLGNRDDTTTFHYNLFEQTSSEEENSKKNLLDMVERSAYYAVRVILKRLLSEHENARFVVTGHSLGGALAILFPTLLVLNEETEIMKRLLGVYTFGQPRIGNREVGLFMKAQLNQPVDRYFRVVYCNDIVPRLPYDDKTFLYKHFGLCLFYDSFYNETKAEDEPDPNPYGLRYKILGHVIAVWELVRGLTMGYTHGPDYKEGWFRILFRLMGLVIPGLSDHCMTDYVNSVRLGPDNELQMSSL

SEQ ID NO: 171 - protein, 348 aa, Arabidopsis thaliana
MAASKLLVSDIASVVDHVPSNYVRPVSDRPKMSEVQTSGDSIPLIDLHDLHGPNRADIINQFAHACSSCGFFQIKNHGVPEETIKKMMNAAREFFRQSESERVKHYSADTKKTTRLSTSFNVSKEKVSNWRDFLRLHCYPIEDFINEWPSTPISFREVTAEYATSVRALVLTLLEAISESLGLAKDRVSNTIGKHGQHMAINYYPRCPQPELTYGLPGHKDANLITVLLQDEVSGLQVFKDGKWIAVNPVPNTFIVNLGDQMQVISNEKYKSVLHRAVVNSDMERISIPTFYCPSEDAVISPAQELINEEEDSPAIYRNFTYAEYFEKFWDTAFDTESCIDSFKASTA

SEQ ID NO: 172 - protein, 536 aa, Arabidopsis thaliana
MNMMMQKLSILFLHLILLVLLCVHPLTTVADRNSTDWCDKTPYPDPCKCYFKNHNGFQQPTQLSEFRVMLVEAAMDRAISARAELTNSGKNCTDSKKQAVLADCIDLYGDTIMQLNRTLHGVSPKAGAAKSCTDFDAQTWLSTALTNTETCRRGSSDLNVTDFITPIVSNTKISHLISNCLAVNGALLTAGNKGNTTANQKGFPTWLSRKDKRLLRAVRANLVVAKDGSGHFNTVQAAIDVAGRRKVTSGRFVIYVKRGIYQENINVRLNNDDIMLVGDGMRSTIITGGRSVQGGYTTYNSATAGIEGLHFIAKGITFRNTAGPAKGQAVALRSSSDLSIFYKCSIEGYQDTLMVHSQRQFYRECYIYGTVDFIFGNAAAVFQNCLILPRRPLKGQANVITAQGRADPFQNTGISIHNSRILPAPDLKPVVGTVKTYMGRPWMKFSRTVVLQTYLDNVVSPVGWSPWIEGSVFGLDTLFYAEYKNTGPASSTRWRVSWKGFHVLGRASDASAFTVGKFIAGTAWLPRTGIPFTSGL

SEQ ID NO: 173 - protein, 333 aa, Arabidopsis thaliana
MLFLTAAVCLICFYVYKSVKPPPPIPLPENVSEISPRIKLNDGRYLAYKELGFPKDKAKNKIIILHGFGSSKLVDLKITQEMIDEFEIYFLLFDRAGYGESDPHPSRTLKTDTYDIEELADKLQIGPKFHVLGMSLGAYPVYGCLKYIPHRLSGATLVVPILNFWWSCLPLNLSISAFKKLPIQNQWTLGVAHYFPWLLYWWMTQKWFSPFSQNPRETMTERDIELADKHTKHAYIKESALRQGEYVSMQRDIIAGYENWEFDPTELSNPFSDDNKGSVHIWCALEDKQISHEVLLYLCDKLPWIKLHEVPDAGHLIIHEKQHFEDIIKAACS

SEQ ID NO: 174 - protein, 316 aa, Arabidopsis thaliana
MVKLATAREIRTYGPRLGRSRAEYINAGLYLFATVVLIGGFTATGFSWEPRSGLVLILLALVLITAVNVHDLVAHLAGIDYRLRLMEYDLQLGLVEFAVPLVQIAGSVVFFLGIFFVFHQAETKRGYSGREHHALNLLIAGPLLWLIGSIHNSCQIYERADSHVQILQQCVYIPFLVGSLLFLVSAVLNSLDISGSSRSGLKLLGERWIWLGISGAICLFVGGLLNVVKVFNFVQISGLRLEKLRGGAQDRLLEGREGYLPLVAEEERIRKMEADHEASSRAKPRAHTTSKAGEGATETVVVSSPTPYKDVLVGQI

SEQ ID NO: 175 - protein, 465 aa, Arabidopsis thaliana
MRNLSFIVLFLLTLFFIHHLVDASLLVKSLPGFEGPLPFELETGYVSIGESGDVELFYYFVKSERNPENDPLMIWLTGGPGCSSICGLLFANGPLAFKGDEYNGTVPPLELTSFSWTKVANILYLEAPAGSGYSYAKTRRAFESSDTKQMHQIDQFLRSWFVKHPEFISNPFYVGGDSYSGKIVPGAVQQISLGNEKGLTPLINIQGYVLGNPVTDKNIETNYRVPFAHGMGLISDELFESLERSCGGKFFNVDPSNARCSNNLQAYDHCMSEIYSEHILLRNCKVDYVLADTPNIRTDRRRVMKEFSVNDSSSLPPPSCFTYRYFLSAFWANDENVRRALGVKKEVGKWNRCNSQNIPYTFEIFNAVPYHVNNSLKGFRSLIYSGDHDSMVPFSSTQAWIRALNYSIVDDWRPWMMSSNQVAGYTRTYANKMTFATIKGGGHTAEYTPDQCSLMFRRWIDGEPL

SEQ ID NO: 176 - protein, 415 aa, Arabidopsis thaliana
MTHNLFAPLDLSFSSSSSSSSSTKTWRYRRGYIEPWWRPNITKGYVFLERPPGPDLLPWPQQSPPFSVNKESFITNKFKTQIRLFYSLQESFKKASKETRWFVIGDDDTLFFLDNLVKALDRYNHKKHYYVGMNSENVWSNAIFAFDMGYGGGGYALSYPTVVTLLSNMEECIKRYLGVYSDLLSFRCLADLGIDLTLEKGMHQNDLHGDISGLLSAHPQSPLISLHHFDVIDPIFPGMNRQQSVNHLMETAKTDQSRVLQQTICYQRGYNWSVSVSWGYSVHIYQSIYPRSHLKRPLETFRPWKDVRIPAYGFNTRRVTNDPCEMPRQFFFDSVVEDKNQSLVTTIYKMKMERRLPPCLLNGNHSSRNITQVRVIATTMHKMVEGIECCDVQNVNSTEILEVKIRDCHIDEALA

SEQ ID NO: 177 - protein, 103 aa, Arabidopsis thaliana
MVTYPNGDRHCVMAQGQVISACLQQANGLPHADCCYAINDVNRYVETIYGRLALCKCFQEILKDSRFTKLIGMPEKCAIPNAVPFDPKTDCDRFVEHIWLKMF

SEQ ID NO: 178 - protein, 61 aa, Arabidopsis thaliana
MDLQQSETDDKQPEQLVIYVCGDCGQENILKRGDVFQCRDCGFRILYKKRILDKKETRIGV

SEQ ID NO: 179 - protein, 233 aa, Arabidopsis thaliana
MRISCNGCRVLRKGCNQDCTIRPCLQWIKSADSQANATLFLAKFYGRAGLLNLIESGPDHLRPAIFRSLLYEACGRIVNPVDGSVGLMWSGNWAQCQAAVDAVLNGLPITHTPLPSASASHQIIPPHRTYDIRHVAKDPTTGGDSSENLATRVNANKSKTQTGRFKRESVNQLGECSHDMWQLPSSSATHGYGHFTLENVESRREAPFNQSSPNLGFDDQVDINEVGLELRLG

SEQ ID NO: 180 - protein, 896 aa, Arabidopsis thaliana
MSTVNHHCLLNFPHIPPSIPPNHRPKLLSSLSLYRKPERLFALSASLSLSPATIHECSSSSSSSSSSFDKEETEDIESVIDGFFYLLRLSAQYHDVEVTKAVHASFLKLREEKTRLGNALISTYLKLGFPREAILVFVSLSSPTVVSYTALISGFSRLNLEIEALKVFFRMRKAGLVQPNEYTFVAILTACVRVSRFSLGIQIHGLIVKSGFLNSVFVSNSLMSLYDKDSGSSCDDVLKLFDEIPQRDVASWNTVVSSLVKEGKSHKAFDLFYEMNRVEGFGVDSFTLSTLLSSCTDSSVLLRGRELHGRAIRIGLMQELSVNNALIGFYSKFWDMKKVESLYEMMMAQDAVTFTEMITAYMSFGMVDSAVEIFANVTEKNTITYNALMAGFCRNGHGLKALKLFTDMLQRGVELTDFSLTSAVDACGLVSEKKVSEQIHGFCIKFGTAFNPCIQTALLDMCTRCERMADAEEMFDQWPSNLDSSKATTSIIGGYARNGLPDKAVSLFHRTLCEQKLFLDEVSLTLILAVCGTLGFREMGYQIHCYALKAGYFSDISLGNSLISMYAKCCDSDDAIKIFNTMREHDVISWNSLISCYILQRNGDEALALWSRMNEKEIKPDIITLTLVISAFRYTESNKLSSCRDLFLSMKTIYDIEPTTEHYTAFVRVLGHWGLLEEAEDTINSMPVQPEVSVLRALLDSCRIHSNTSVAKRVAKLILSTKPETPSEYILKSNIYSASGFWHRSEMIREEMRERGYRKHPAKSWIIHENKIHSFHARDTSHPQEKDIYRGLEILIMECLKVGYEPNTEYVLQEVDEFMKKSFLFHHSAKLAVTYGILSSNTRGKPVRVMKNVMLCGDCHEFFKYISVVVKREIVLRDSSGFHHFVNGKCSCRDLW

SEQ ID NO: 181 - protein, 335 aa, Arabidopsis thaliana
MDIFVSFVVFILSVLSVESTIHMKSIKLGKNVIYDCMDIYKQPSLSHPLLKHHNIRMKPTGWDSQSENKFAERRHNNKIECPNGTVPILRAKEKHVIQYQEYPINNFTVLTAKYPGTHIAGMKVVEKHNYRGVEAGLRTYNLIIDKNQSTSAQAYVARAFSGDANSIQVGWMINEQLFGDKRPWSYGTWLGKHGTGCFNVKCPGFVQVAKNGPISVPLKFDYLLWLTIHQELFNLLGDGADFVGFGGMVSGDPRTPSPPMGNGRLPNKDDRLWSGYLDHLTIIQPDYEHAGFNYPMTEPLVDSNVCYDVNLVGYVDHQVGIAMSYGGPGGIKCGD

SEQ ID NO: 182 - protein, 199 aa, Arabidopsis thaliana
MADTHRVDRTDRHFQFQSPYEGGRGQGQYEGDRGYGGGGYKSMMPESGPSSTQVLSLLIGVPVVGSLLALAGLLLAGSVIGLMVALPLFLLFSPVIVPAALTIGLAMTGFLASGMFGLTGLSSISWVMNYLRGTRRTVPEQLEYAKRRMADAVGYAGQKGKEMGQHVQNKAQDVKQYDISKPHDTTTKGHETQGRTTAA

SEQ ID NO: 183 - protein, 516 aa, Arabidopsis thaliana
MSSSSYNTSVIPSSSSSAQPFFITSSGTGDNDFNRKDTFMSMIQQPNSSAPPPKKRRNQPGNPNPDAEVVALSPKTLMATNRFICDVCNKGFQREQNLQLHRRGHNLPWKLKQKSTKEVKRKVYLCPEPTCVHHDPSRALGDLTGIKKHYYRKHGEKKWKCEKCSKRYAVQSDWKAHSKTCGTKEYRCDCGTIFSRRDSYITHRAFCDALIQETARNPTVSFTSMTAASSGVGSGGIYGRLGGGSALSHHHLSDHPNFGFNPLVGYNLNIASSDNRRDFIPQSSNPNFLIQSASSQGMLNTTPNNNNQSFMNQHGLIQFDPVDNINLKSSGTNNSFFNLGFFQENTKNSETSLPSLYSTDVLVHHREENLNAGSNVSATALLQKATQMGSVTSNDPSALFRGLASSSNSSSVIANHFGGGRIMENDNNGNLQGLMNSLAAVNGGGGSGGSIFDVQFGDNGNMSGSDKLTLDFLGVGGMVRNVNRGGGGGGRGSARGGVSLDGEAKFPEQNYPFGRG

SEQ ID NO: 184 - protein, 98 aa, Arabidopsis thaliana
MATKSVSTFAIFFILVLAIFETPEIEAYDRKCLKEYGGDVGFSYCAPRIFPTFCDQNCRKNKGAKGGVCRWEENNAIGVKCLCNFCSEEPSDQTLSRI

SEQ ID NO: 185 - protein, 99 aa, Arabidopsis thaliana
MATKSVSTFAIFFILVLAIFAETPEIEAYDRKCLKEYGGDVGFSYCAPRIFPTFCDQNCRKNKGAKGGVCRWEENNAIGVKCLCNFCSEEPSDQTLSRI

SEQ ID NO: 186 - protein, 317 aa, Arabidopsis thaliana
MFKLCLVLVLVIAVDANPAKSGSCSCSGNISASDVDRVHFAMNLEFTEAEFFLKGATGKGLDAYNATLAKGGPPPIGAKKANLDPITNRIIEEFGYQEIGHLRAITDMTGGIPRPLINLTRENFAVFMDRAVGRKSNPRFDPYANSLNYLLASYYIPYVGLTGYVGTIPYLVYFNIKKLVAGLLGVESGQDAVIRTLLYERQNEKVEEYGGVTVAELTNEISNLRNELGMCGIKDEGLCVPLWLGAENRTTSNILSADPYSLSYDRTAQEILRVMYGTGDEHRPGGFWPCGANGRIARMFLDEGCYGEYCVVCSHDN

SEQ ID NO: 187 - protein, 761 aa, Arabidopsis thaliana
MRVPLIDFLRFLVLILSLSGASVAADATVKQNFNKYETDSGHAHPPPIYGAPPSYTTPPPPIYSPPIYPPPIQKPPTYSPPIYPPPIQKPPTPTYSPPIYPPPIQKPPTPTYSPPIYPPPIQKPPTPTYSPPIYPPPIQKPPTPSYSPPVKPPPVQMPPTPTYSPPIKPPPVHKPPTPTYSPPIKPPVHKPPTPIYSPPIKPPPVHKPPTPIYSPPIKPPPVHKPPTPTYSPPVKPPPVHKPPTPIYSPPIKPPPVHKPPTPIYSPPVKPPPVQTPPTPIYSPPVKPPPVHKPPTPTYSPPVKSPPVQKPPTPTYSPPIKPPPVQKPPTPTYSPPIKPPPVKPPTPIYSPPVKPPPVHKPPTPIYSPPVKPPPVHKPPTPIYSPPVKPPPIQKPPTPTYSPPIKPPPLQKPPTPTYSPPIKLPPVKPPTPIYSPPVKPPPVHKPPTPIYSPPVKPPPVHKPPTPTYSPPIKPPPVKPPTPTYSPPVQPPPVQKPPTPTYSPPVKPPPIQKPPTPTYSPPIKPPPVKPPTPTYSPPIKPPPVHKPPTPTYSPPIKPPPIHKPPTPTYSPPIKPPPVHKPPTPTYSPPIKPPPVHKPPTPTYSPPIKPPPVHKPPTPTYSPPIKPPPVHKPPTPTYSPPIKPPPVHKPPTPTYSPPIKPPPVQKPPTPTYSPPVKPPPVQLPPTPTYSPPVKPPPVQVPPTPTYSPPVKPPPVQVPPTPTYSPPIKPPPVQVPPTPTTPSPPQGGYGTPPPYAYLSHPIDIRN

SEQ ID NO: 188 - protein, 437 aa, Arabidopsis thaliana
MEFESVFKMHYPYLAAVIYDDSSTLKDFHPSLTDDFSCVHNVHHKPSMPHTYEIPSKETIRGITPSPCTEAFEACFHGTSNDHVFFGMAYTTPPTIEPNVSHVSHDNTMWENDQNQGFIFGTESTLNQAMADSNQFNMPKPLLSANEDTIMNRRQNNQVMIKTEQIKKKNKRFQMRRICKPTKKASIIKGQWTPEEDKLLVQLVDLHGTKKWSQIAKMLQGRVGKQCRERWHNHLRPDIKKDGWTEEEDIILIKAHKEIGNRWAEIARKLPGRTENTIKNHWNATKRRQHSRRTKGKDEISLSLGSNTLQNYIRSVTYNDDPFMTANANANIGPRNMRGKGKNVMVAVSEYDEGECKYIVDGVNNLGLEDGRIKMPSLAAMSASGSASTSGSASGSGSGVTMEIDEPMTDSWMVMHGCDEVMMNEIALLEMIAHGRL

SEQ ID NO: 189 - protein, 231 aa, Arabidopsis thaliana
MALLCHHQSEVQAAQKPSPVACWSSINKVQGCVDAVKAATKGDYKGLSKDCCLAIYGLIDDCFPIVFSGKPDIAVLVKDACAMVTFRLQNLERKIDSTMDIIAELRQRESVYRTAFVLTKAETEVKQFVIKTKMGTKQIVTVMFFFLSVIMALLCHHQSEAQAPIPTPGDCFSSIKKVKGCADAVKAATKGHLLRLVKDCCHVINDLADDCFPIIFPGKPYIAALVKHACS

SEQ ID NO: 190 - protein, 303 aa, Arabidopsis thaliana [sequence omitted]

SEQ ID NO: 191 - protein, 438 aa, Arabidopsis thaliana
MIHGLPSMKSIKSLKSLVKRKTNAQEVSKSGWKMKPFLALMCTALLIFWYKTTNIQFEQTEIEETDYPFDMAKESEAVNDKLKGLPRGIIQSRSDLELKPLWSRGSLRSKGVEMTNRNLLAIPVGLKQKGNVDALVKKFLPANFTIVLFHYDGNMDKWWDLEWSSKSIHIVAQNQTKWWFAKRFLHPDVVSIYDYIFLWDEDLGVENFNPERYLKIVKSVGLEISQPALDHNSTEIHHKITLRSKTKKFHRRVYINRGHKRCSNTSSDPPCTGFVEGMAPVFSKAAWLCTWNLIQNDLVHGWGMDMKLGYCAQGDRTKNVGIVDSEYILHQGIQTLGESVPEKKKTARDVGTRRQGHTTFDSRTEIRRQSTWELQTFKERWSKAVEEDIKWIDPSSSSSMTKRKSNGNNRRLRRGSSSSHRVKHKRSQETSRTTTTHK

SEQ ID NO: 192 - protein, 335 aa, Arabidopsis thaliana
MIHGLPSMKSIKSLKSLVKRKTNAQEVSKSGWKMKPFLALMCTALLIFWYKTTNIQFEQTEIEETDYPFDMAKESEAVNDKLKGLPRGIIQSRSDLELKPLWSRGSLRSKGVEMTNRNLLAIPVGLKQKGNVDALVKKFLPANFTIVLFHYDGNMDKWWDLEWSSKSIHIVAQNQTKWWFAKRFLHPDVVSIYDYIFLWDEDLGVENFNPERYLKIVKSVGLEISQPALDHNSTEIHHKITLRSKTKKFHRRVYINRGHKRCSNTSSDPPCTGFVEGMAPVFSKAAWLCTWNLIQNDLVHGWGMDMKLGYCAQVTFFLYNSRFCGRPNEKRRDCG

SEQ ID NO: 193 - protein, 392 aa, Arabidopsis thaliana
MPTQKDQNSPLSQVIELLKKLLHHFHNLLLYFFILWIGVIVGIIVYPSLQGLSSPSSLTIQSVSQLFFVTPPPPILSPSFQDNGLDMFLIPLKNIMHDMEDNELLWRASMDPKIRDYPYPRIPKVAFMFLTWGPLPLAPLWERFFRGHEGLFTIYVHTNSSYDEFMPQDSVFYGRRIPSKRVDWGNANMVEAERRLLANALLDINNERFILLSESCIPLFNFSTVYSFLIDSTLTHVDSYDLTIGRVRYDRRMYPHIRMHQWRKGSQWFELDRAMALEVVSDTFYWPIFKAYSRCPDEHYIPTLLNMRPSLGLRNANRTLTWTDWSKRRAHPRLFGEWEVNVEFLEWLRMKSVGDCKKNGENKMRLCFLFARKFSSTALDELLRLASIVMYF

SEQ ID NO: 194 - protein, 374 aa, Arabidopsis thaliana
MAKSDMLPFLAMVLVQIGYAGMNITSKMAMEAGMKPLILVAYRQIFATIATFPVAFFLERKTRPKITLRILVQVFFCSITGATGNQVLYFVGLQNSSPTIACALTNLLPAVTFLLAAIFRQETVGIKKASGQAKVIGTLVCVIGAMVLSFYHGHTIGIGESKIHWAYAENITKHGSSSGHSNFFLGPFLIMAAAVSWAAWFIIQTKMSETFAAPYTSTLLMCLMGSIQCGAIALISDHTISDWSLSSPLRFISALYAGVVASALAFCLMSWAMQRKGPLYVSVFSPLLLVVVAIFSWALLEEKLYTGTFMGSALVVIGLYGVLWGKDREVSEKEEEREKVKQQNHKVKSESNEDIESRLPVASSGNGSTRSTSP

SEQ ID NO: 195 - protein, 177 aa, Arabidopsis thaliana
MELPPKVKNILLLDSEGKRVAVKYYSDDWPTNSAQEAFEKSVFTKTQKTNARTEVEVTALENNIVVYKFVQDLHFFVTGGEEENELILASVLEGLFDAVTLLLRSNVDKREALDNLDLIFLSFDEIIDGGIVLETDANVIAGKAGINSTDPNAPLSEQTISQALATAREHLTRSLMK

SEQ ID NO: 196 - protein, 98 aa, Arabidopsis thaliana
MASYESQRDVAELATLEQTKKNVEDVEEVLKKLEQTYLGKEKVTDDTLLSDEEMEKFNQMMNCVKLLNNCLTKIGQSLPLKEGERELVEVEVDFKNIP

SEQ ID NO: 197 - protein, 511 aa, Arabidopsis thaliana
MEKNKRAIGFLLLVVLINGVMMTRSNGYEGEEEWGGAGGGEWGGAEGGGAWGGGGGGGGAWGGEGEGGGEWGGGGEGGGGGRRGWFMMRESRQVIKSEGGEMRVVLSPRGRIIEKPMHIGFLTMEPKTLFVPQYLDSSLLIFIRQGEATLGVICKDEFGERKLKAGDIYWIPAGSVFYLHNTGLGQRLHVICSIDPTQSLGFETFQPFYIGGGPSSVLAGFDPHTLTSAFNVSLPELQQMMMSQFRGPIVYVTEGPQPQPQSTVWTQFLGLRGEEKHKQLKKLLETKQGSPQDQQYSSGWSWRNIVRSILDLTEEKNKGSGSSECEDSYNIYDKKDKPSFDNKYGWSIALDYDDYKPLKHSGIGVYLVNLTAGAMMAPHMNPTATEYGIVLAGSGEIQVVFPNGTSAMNTRVSVGDVFWIPRYFAFCQIASRTGPFEFVGFTTSAHKNRPQFLVGSNSLLRTLNLTSLSIAFGVDEETMRRFIEAQREAVILPTPAAAPPHVGEMVSDRFV

SEQ ID NO: 198 - protein, 403 aa, Arabidopsis thaliana
MLSNKLGFFVKSKARPEAVKLVGSKGLVFIEGADWVRHRRILNPAFSIDRLKIMTTVMVDCTLKMLEEWRKESTKEETEHPKIKKEMNEEFQRLTADIIATSAFGSSYVEGIEVFRSQMELKRCYTTSLNQVSIPGTQYLPTPSNIRVWKLERKMDNSIKRIISSRLQSKSDYGDDLLGILLKAYNTEGKERKMSIEEIIHECRTFFFGGHETTSNLLAWTTMLLSLHQDWQEKLREEIFKECGKEKTPDSETFSKLKLMNMVIMESLRLYGPVSALAREASVNIKLGDLEIPKGTTVVIPLLKMHSDKTLWGSDADKFNPMRFANGVSRAANHPNALLAFSVGPRACIGQNFVMIEAKTVLTMILQRFRFISLCDEYKHTPVDNVTIQPQYGLPVMLQPLED

SEQ ID NO: 199 - protein, 519 aa, Arabidopsis thaliana
MGLVIFLALIVLILIIGLRIFKAFMILVWHPFVLTRRLKNQGISGPNYRIFYGNLSEIKKMKRESHLSILDPSSNDIFPRILPHYQKWMSQYGETFLYWNGTEPRICISDPELAKTMLSNKLGFFVKSKARPEAVKLVGSKGLVFIEGADWVRHRRILNPAFSIDRLKIMTTVMVDCTLKMLEEWRKESTKEETEHPKIKKEMNEEFQRLTADIIATSAFGSSYVEGIEVFRSQMELKRCYTTSLNQVSIPGTQYLPTPSNIRVWKLERKMDNSIKRIISSRLQSKSDYGDDLLGILLKAYNTEGKERKMSIEEIIHECRTFFFGGHETTSNLLAWTTMLLSLHQDWQEKLREEIFKECGKEKTPDSETFSKLKLMNMVIMESLRLYGPVSALAREASVNIKLGDLEIPKGTTVVIPLLKMHSDKTLWGSDADKFNPMRFANGVSRAANHPNALLAFSVGPRACIGQNFVMIEAKTVLTMILQRFRFISLCDEYKHTPVDNVTIQPQYGLPVMLQPLED

SEQ ID NO: 200 - protein, 283 aa, Arabidopsis thaliana
MGLVTQLLGLPLIPAYSEATGDQVLRGVNYASAAAGILPDTGGNFVGRIPFDQQIHNFETTLDQVASKSGGAVAIADSVTRSLFFIGMGSNDYLNNYLMPNFPTRNQYNSQQFGDLLVQHYTDQLTRLYNLGGRKFVVAGLGRMGCIPSILAQGNDGKCSEEVNQLVLPFNTNVKTMISNLNQNLPDAKFIYLDIAHMFEDIVANQAAYGLTTMDKGCCGIGKNRGQITCLPFETPCPNRDQYVFWDAFHPTEKVNLIMAKKAFAGDRTVAYPINIQQLASLN

SEQ ID NO: 201 - protein, 539 aa, Arabidopsis thaliana
MEPSKQEVPKLMETPPNISNDSSATEKGEATRQQQLPNNRYALTVDEVIEQHIGALGFAQILHALLVSIAWIFDAQTTLISIFSDAQPAARLLATGAIVEGASLCGLASGEWEWIGPKSDTVVSEWNLICQHKFLVAVPSTLFFIGSLFGSGVYGYLADSWFGRKKTLLLSCVLTFVTAFAISFSPNVWVYAFLRFANGFFRSGIGSCCIVLATEIVGKKWRGQVGQYGFFFFTLGFLSLPLMAYLERKSWRNLYRIISFLPLGYAVCLLPFAYESPRWLLVKGRNKEAMVVLKKLARLNGKQLPADLSLVDPIPERDDQTSSSEKFWKTKWAVKRIIMVMMAGFGSGFVYYGIQLNAENLNFNLYLTVAVNALMEFPAVFIGSFLLGVMNRRPLFSNSSYLAGFACLLCAVLSIHRVIRAISVAKWLQLAVEAVGFMASSTAYDVLYVYCVELFPTNVRNTAVSLLRQAFMLGASAAPLLVALGRESAMMSFIVFGVASVLSGIVSLWLRETRNAPLYETLAQQGKAEEIENETIMIT

SEQ ID NO: 202 - protein, 208 aa, Arabidopsis thaliana
MHTSLPLFPSLSLSHSPKTIMPNAGSERAASLSLKKQDTATFSGKLPSTKQRFSSVSAACPSFRIYYYDGAAGAVPFEWESHPGTPKHPSSELPTLPPLTPPPSHFSFSGDQIRRRSKKSTKKILALIPTRLFWLSGDHNGKAKKLSASSPPSLSERVLIDENEYDLFKFQTERNVMRRFSSFDSSADYPIQRSQSTSCFGIRRCFLC

SEQ ID NO: 203 - protein, 362 aa, Arabidopsis thaliana
MSSSSSMDLLMCLLLLISPVVLAKSSSTVPAIFTFGDSIFDAGNNHYNKNCTAQADFPPYGSSFFHRPTGRFTNGRTVADFISEFVGLPLQKPFLELQIQILNGTSNFSNGINFASAGSGLLLDTNKFMGVTPIQTQLQQFQTLVEQNLIEKSIIQESLFLLETGSNDIFNYFLPFRAPTLSPDAYVNAMLDQVNKTIDQIYKLGARRIAFFSLGPVGCVPARAMLPNAPTNKCFGKMNVMAKMYNKRLEDIVNIIPTKYPGAIAVFGAVYGITHRFQTYPARYGFSDVSNACCGNGTLGGLMQCGREGYKICNNPNEFLFWDFYHPTEHTYRLMSKALWNGNKNHIRPFNLMALATNKITF

SEQ ID NO: 204 - protein, 103 aa, Arabidopsis thaliana
MKFTALVFIVFVVGVMVSPVSIRATEVKLSGGEADVTCDAVQLSSCATPMLTGVPPSTECCGKLKEQQPCFCTYIKDPRYSQYVGSANAKKTLATCGVPYPTC

SEQ ID NO: 205 - protein, 272 aa, Arabidopsis thaliana
MGKRRGVSAVNVVFGWLRQQSNKVKIALGIIISLILVVLLKFTVRNHNHFFIASELIHAAGILILIYKLTRQKTCSGLSLKSQEVTAIFLAVRLICSINMEGDIHTVLDFATLVSTLWVIYMIRYKLKASYIKSLDTCYNYYVLVPSAILALIINPSTSYSYFHRILWAFCVYTESVSVLPQLRLMQNAQIIEPFTAHYVFALGIARFLACAHWIIQVVETRGHYLWLLGAGYFWFPVALLAEIVQTFILADFCYYYVKSVMEGQLVLKMPV

SEQ ID NO: 206 - protein, 173 aa, Arabidopsis thaliana
MAASVDPLVVGRVIGDVLDMFIPTANMSVYFGPKHITNGCEIKPSTAVNPPKVNISGHSDELYTLVMTDPDAPSPSEPNMREWVHWIVVDIPGGTNPSRGKEILPYMEPRPPVGIHRYILVLFRQNSPVGLMVQQPPSRANFSTRMFAGHFDLGLPVATVYFNAQKEPASRRR

SEQ ID NO: 207 - protein, 677 aa, Arabidopsis thaliana
MKVGAPASKPGRIIVQVFLLQLLLLLQSVHSQRSQNKLNITKPGQNIPALTVQLRRVGHDTVVVDNGIVQVTFSNPEGLITGIKYHGIDNVLDDKIDDRGYWDVVWYEPEKKQKTDKLEGTKFEIITQNEEQIEISFTRTWTISRRGSLVPLNVDKRYIIRSGVSGLYMYGILERLEGWPDVDMDQIRIVFKLNPKKFDFMAISDDRQRSMPSMADRENSKSLAYKEAVLLTNPSNPMFKGEVDDKYMYSMEDKDNNVHGWISSDPPVGFWMITPSDEFRLGGPIKQDLTSHAGPITLSMFTSTHYAGKEMRMDYRNGEPWKKVFGPVLAYLNSVSPKDSTLRLWRDAKRQMAAEVKSWPYDFITSEDYPLRHQRGTLEGQFLIKDSYVSRLKIYGKFAFVGLAPIGEAGSWQTESKGYQFWTKADRRGRFIIENVRAGNYSLYAWGSGFIGDYKYEQNITITPGSEMNVGPLVYEPPRNGPTLWEIGVPDRTAGEFYIPDPYPTLMNKLYVNPLQDRFRQYGLWDRYADLYPQNDLVYTIGVSDYRSDWFFAHVARNVGNDTYQPTTWQIIFNLKNVNRIGRYTLRIALASAADSELQIRINDPKSDAIFTTGFIGKDNAIARHGIHGLYRLYSIDVAGNLLSVGDNTIFLTQTRSRTPFQGIMYDYIRLESPFRT

SEQ ID NO: 208 - protein, 764 aa, Arabidopsis thaliana
MIRGGRNNITSAPAFSKDAKKLLLCTANTVSVYSVATGLKITSLEDHTAPVTSVIVDPSSDETVSYCWTSSLDGKIRIWEFSAPKLLKIFDTHLPIHSLVMIPAQVSHSVIAYVSVEDYSSVSKDLFGQIRRYDLTQDPLHSGDTLKEMEEPKPIVLSPSGEFFGVCHNCSIHIWNVASEHLMPKETTLHHTELITVFAFHPNQRILAAGDVTGRVLIWKDNGIGEFTSVKTEDDTESCTTFNWHSAEVTVLNFSSDGALLYSGVKAGDFVVWELGTGKKQLLPKIGSPLLYFIFSSDSTLSSVICADNQIHLLKMPSMEILRTISGIKPPTPERHGFICYVKTRDICLTRTVSIDRSSGIAAFCTANHRVQLYNLLSDHDISEVQICDHHPDDDDQVRVLVTAVALSRNGSVMTTAEARFAASNFSEGIVSLKFWVFVPDSKTFSLSTVINQPHREAAITAIALNPARSMAVSISSAGDFKIWVCSSDKNLTPEDSNWICHGVGSYKRTPITAAVFSGDGSCLALAAKTVITIWHPLKNELLYVVGKANAPIMELSFTGGGFLIAASHGSTPHLSVWDLMTFCLSWSYRLYIEAIATEVDSPYFAVLTWLPESDRLVKSNEQIFRGKDGAILLFDGSGPKPVAIWTVMKARGGTLSFVEDGKKSQPLLAYVNRSHEYVLFDPYSDEKLETSAIDYEVFLAAISKKKKRSRKKALMSEKPWETMFCGSTLNFPPFPDLCASFFSSRMQKEVCERADRQPERHSS

SEQ ID NO: 209 - protein, 441 aa, Arabidopsis thaliana
MAHFLETQEPLVFSGKKRNDRDDEDGDALVAKKSALAVCDADPAAAIANIRHEFGEHGGVNMSIEASATFTVMEPDTMRRMFTGELGPDNDFYVYSRHFNPTVLNLSRQMAALEGTQAAYCTSSGMSAISSVMLQLCSSGGHVVAASTLYGGTHALLSHFLPRTCNITTSFVDITDHGAVANAIVEGRTQVLYFESVANPTLTVADIPELSRMAHEKGVTVVVDNTFAPMVLSPAKLGADVVVHSISKFISGGADIIAGAVCGSENLVKEMMDLRGGSLMLLGPTMNAKVAFELSERIPHLGLRMREHSHRAQVYAERMRDLGMKVIYPGLETHPQHKLFKGMVNRDYGYGGLLSIDMETEEKANKLMAYLQNATQFGFMAVSLGYYETLMSCSGSSTSSELDPSQKEAAGISPGLVRMSVGYVGTLEQKWTQFEKAFLRM

SEQ ID NO: 210 - protein, 397 aa, Arabidopsis thaliana
MAKTDVDDEYGLKPSELYGKNTWKIKKFSQISKREFASSVFEIGGYSWHILMYPEGCDVSNHLSLFLCVANHDELLPGWSQLAQFTISVMHKDPKKSKFSDTLHRFWKKEHDWGWKKFMELPKLRDGFIDDSGCLTIETKVQVIRDRVDRPFFLDYGYKTEIVRVYFRNIEQIFLRFVEERRSKLEKLIEDKAKWTSFGVFWLGMDKNSRREMSREKMDVILKGFVKHFFMENVVTSPIAMDCLYNGLKDLEVQTKNKKASPKLLDDKELPAPFVKVDRDMFVLVDDDVLLLLERAALLERAAPEPLPPKDDKALQNRIKEDKDEEDINKEAYEICLNEWGRRTVEIFVLDHIFSKIEVAYKEAIALKRQEELIREEEETSKRSKVLKKGFGKCRLN

SEQ ID NO: 211 - protein, 346 aa, Arabidopsis thaliana
MYPEGCDVSNHLSLFLCVANHDELLPGWSQLAQFTISVMHKDPKKSKFSDTLHRFWKKEHDWGWKKFMELPKLRDGFIDDSGCLTIETKVQVIRDRVDRPFFLDYGYKTEIVRVYFRNIEQIFLRFVEERRSKLEKLIEDKAKWTSFGVFWLGMDKNSRREMSREKMDVILKGFVKHFFMENVVTSPIAMDCLYNGLKDLEVQTKNKKASPKLLDDKELPAPFVKVDRDMFVLVDDDVLLLLERAALLERAAPEPLPPKDDKALQNRIKEDKDEEDINKEAYEICLNEWGRRTVEIFVLDHIFSKIEVAYKEAIALKRQEELIREEEETSKRSKVLKKGFGKCRLN

SEQ ID NO: 212 - protein, 274 aa, Arabidopsis thaliana
MNSCSLGAPKVRIFATNFSRLRCGNLLIPNNQRLFVDQSPMKYLSLRTTLRSVKAIQLSTVPPAETEAIADVKDSDETKSTVVNTHLMPKSSEVEALISEITDSSSIAEFELKLGGFRLYVARKLTDESSPPPQQIQPVVAASATPEGVHTNGSATSSSLAITKTSSSSADRPQTLANKAADQGLVILQSPTVGYFRRSKTIKGKRTPTICKEKDIVKEGQVLCYIEQLGGQIPVESDVSGEIVKILREDGEPVGYNDALITVLPSFPGIKKLQ

SEQ ID NO: 213 - protein, 182 aa, Arabidopsis thaliana
MATHSSFTATTPLFLIVLLSLSSVSVLGASHHHATAPAPSVDCSTLILNMADCLSFVSSGGTVAKPEGTCCSGLKTVLKADSQCLCEAFKSSASLGVTLNITKASTLPAACKLHAPSIATCGLSVAPSTAPGLAPGVAAAGPETAGFLAPNPSSGNDGSSLIPTSFTTVLSAVLFVLFFSSA

SEQ ID NO: 214 - protein, 178 aa, Arabidopsis thaliana
MATHSSFTATTPLFLIVLLSLSSVSVLGASHHHATAPAPSVDCSTLILNMADCLSFVSSGGTVAKPEGTCCSGLKTVLKADSQCLCEAFKSSASLGVTLNITKASTLPAACKLHAPSIATCGLSVAPSTAPGVAAAGPETAGFLAPNPSSGNDGSSLIPTSFTTVLSAVLFVLFFSSA

SEQ ID NO: 215 - protein, 156 aa, Arabidopsis thaliana
MASADKLINTDVPEKDVFAFHFLQSLSNLRKQNPFDTPDQKNYRVRKIKKAAYVSMARAAGGSSRLWSRALLRRADKDDNKIVRFSRRKWKISSKRRRSNQRAPVVEEAAERLRNLVPGGGGMETSKLMEETAHYIKCLSMQVKVMQCLVDGLSPK

SEQ ID NO: 216 - protein, 68 aa, Arabidopsis thaliana
MTTSKRLADRKIEKFDKNILKRGFVPETTTKKGKDYPVGPILLGFFVFVVIGSSLFQIIRTATSGGMA

SEQ ID NO: 217 - protein, 218 aa, Arabidopsis thaliana
MEGKGKEIVVGHSISKSSVECHKYYLARRTTMEMLRDRGYDVSDEDINLSLQQFRALYGEHPDVDLLRISAKHRFDSSKKISVVFCGTGIVKVNAMRVIAADVLSRENITGLILVLQSHITNQALKAVELFSFKVELFEITDLLVNVSKHVLRPKHQVLNDKEKESLLKKFSIEEKQLPRLSSKDPIVRYYGLETGQVMKVTYKDELSESHVTYRCVS

SEQ ID NO: 218 - protein, 630 aa, Arabidopsis thaliana
MPPRRSYPFSGHGGTIARFIEFGEAFGHYGEEEDEEEEDEEEAYVDYGEVQEEDEEEEEEEDSERQTREYIDVLDSPVRVSQNESEGIENQNRSQGVCSSSSGSQEDVEWKQGDTEGLSCSICMEVWTSGGQHQVCCLPCGHLYGYSCINKWFQQRRSGGKCPLCNKICSLRDVRKIYASRVAAVDDEAHKRILFLEAKLRSIEQKTASWSNKEVQWKITEAELRLEVTKLKKKIANMESTTKGSQSQSNVASQEKYIPAHNIYQEHHGQSPSCSFRHQGDLLINGGRIFDIDGGRQILLYARRLSGVGGTFVLTQMSLHSPCEIDDILLPRTTRAIKDLHLSPHNNGLAVFGSLGKKLSVISLESHNTVLSYDLPAAPWSCSWDLKSSHHIYAGLQNGMVLIFDMRQTTGPFASMTGLTTNPVHTVHHLSGNSTPTSDVRTLLSASSIGLCQWNISGSEGSPSLVSETGNPGVCISSSYCPRSNHIVASYRPRVGSSDDTVPTQPSLTQTGVSNSNSNGVDGFHVCHKRRGVDSYYQKLSSTQAIVDPIRLPRTAIIDFGGERKQLFASCDESTRELILQDPSTFTISQRLPLSSHLPLQDVKYCHVNGSDLLGLLTDDRLQILRNESP

SEQ ID NO: 219 - protein, 361 aa, Arabidopsis thaliana
MTIRSLRKPPPVKLVFPTLIILFLTCLLCILTNFQTISYLFRPLWDKPPPPFKRIPHYYAENVSMGHLCELHGWTPRLEPRRVFDAIIFSNELDLLEVRWRELEPYVSKFVILESNTTFTGIPKPLFFDSNKERFAFAEGKIVHGVFPGKKRSTGQPYEDPFLLEGQQRVAMNWLLREAGVSDGDAVIMSDADEIPSPHTVKFLQWCDGIPDVMHLEMREYMYSFEFPVDYSSWRASVHIYSRKWTQYRHSRQTDLILSDAGWHCSFCFRRLNEFVFKMKGYSHADRVKRKEFLDYQRIQKHICKGYDLFDMLPEKYSFQELISKIGPIPPSASAVHLPAFLIQNAARFRFLLPGGCLREP

SEQ ID NO: 220 - protein, 319 aa, Arabidopsis thaliana
MTKIELRALGNTGLKVSAVGFGASPLGSVFGPVAEDDAVATVREAFRLGINFFDTSPYYGGTLSEKMLGKGLKALQVPRSDYIVATKCGRYKEGFDFSAERVRKSIDESLERLQLDYVDILHCHDIEFGSLDQIVSETIPALQKLKQEGKTRFIGITGLPLDIFTYVLDRVPPGTVDVILSYCHYGVNDSTLLDLLPYLKSKGVGVISASPLAMGLLTEQGPPEWHPASPELKSASKAAVAHCKSKGKKITKLALQYSLANKEISSVLVGMSSVSQVEENVAAVTELESLGMDQETLSEVEAILEPVKNLTWPSGIHQN

SEQ ID NO: 221 - protein, 765 aa, Arabidopsis thaliana
MMEETTDNTGTISSQKNVAASGHNHHHRYKYISNYGVGRRFLFFASCFGFYAFVAATYAWFVFPPHIGRTDHVSSSSLGCREDNEGSWSIGVFYGDSPFSLKPIETRNVWRNESGAWPVTNPVITCASFTNSGLPSNFLADPFLYVQGDTLYLFFETKSPITMQGDIGAAKSIDKGATWEPLGIALDEAWHLSFPFVFNYNGEIYMMPESNEIGQLNLYRAVNFPLSWKLEKVILKKPLVDSTIVHHEGIYWLIGSDHTGFGAKKNGQLEIWYSSSPLGTWKPHKKNPIYNGKRSIGARNGGRAFLYDGSLYRVGQDCGENYGKRIRVSKIEVLSKEEYREVEVPFSLEASRKGKNSWNGVRQHHFDVKQLSSGEFIGLVDGDRVTSGDLFHRVILGYASLAAAISVVILLGFLLGVVNCIVPSTWCMNYYAGKRTDALLNLETAGLFSEKLRRIGSRLNRVPPFLRGFVKPNSSMGKFTLGVIVILGLLLTCVGVRYIYGGSGAVEPYPFKGHLSQFTLATMTYDARLWNLKMYVKRYSRCPSVKEIVVIWNKGPPPDLSELDSAVPVRIRVQKQNSLNNRFEIDPLIKTRAVLELDDDIMMPCDDIEKGFRVWREHPERLVGFYPRFVDQTMTYSAEKFARSHKGYNMILTGAAFMDVRFAFDMYQSDKAKLGRVFVDEQFNCEDILLNFLYANASGSGKAVEYVRPSLVTIDTSKFSGVAISGNTNQHYRKRSKCLRRFSDLYGSLVDRRWEFGGRKDGWDL

SEQ ID NO: 222 - protein, 673 aa, Arabidopsis thaliana
MKKSKLDNSSSQIRFGLVQFLLVVLLFYFLCMSFEIPFIFRTGSGSGSDDVSSSSFADALPRPMVVGGGSREANWVVGEEEEADPHRHFKDPGRVQLRLPERKMREFKSVSEIFVNESFFDNGGFSDEFSIFHKTAKHAISMGRKMWDGLDSGLIKPDKAPVKTRIEKCPDMVSVSESEFVNRSRILVLPCGLTLGSHITVVATPHWAHVEKDGDKTAMVSQFMMELQGLKAVDGEDPPRILHFNPRIKGDWSGRPVIEQNTCYRMQWGSGLRCDGRESSDDEEYVDGEVKCERWKRDDDDGGNNGDDFDESKKTWWLNRLMGRRKKMITHDWDYPFAEGKLFVLTLRAGMEGYHISVNGRHITSFPYRTGFVLEDATGLAVKGNIDVHSVYAASLPSTNPSFAPQKHLEMQRIWKAPSLPQKPVELFIGILSAGNHFAERMAVRKSWMQQKLVRSSKVVARFFVALHARKEVNVDLKKEAEYFGDIVIVPYMDHYDLVVLKTVAICEYGVNTVAAKYVMKCDDDTFVRVDAVIQEAEKVKGRESLYIGNINFNHKPLRTGKWAVTFEEWPEEYYPPYANGPGYILSYDVAKFIVDDFEQKRLRLFKMEDVSMGMWVEKFNETRPVAVVHSLKFCQFGCIEDYFTAHYQSPRQMICMWDKLQRLGKPQCCNMR

SEQ ID NO: 223 - protein, 442 aa, Arabidopsis thaliana
MVDSDPVEFPPENRRGQLFGKYEVGKLVGCGAFAKVYHGRSTATGQSVAIKVVSKQRLQKGGLNGNIQREIAIMHRLRHPSIVRLFEVLATKSKIFFVMEFAKGGELFAKVSKGRFCEDLSRRYFQQLISAVGYCHSRGIFHRDLKPENLLLDEKLDLKISDFGLSALTDQIRPDGLLHTLCGTPAYVAPEVLAKKGYDGAKIDIWSCGIILFVLNAGYLPFNDHNLMVMYRKIYKGEFRIPKWTSPDLRRLLTRLLDTNPQTRITIEEIIHDPWFKQGYDDRMSKFHLEDSDMKLPADETDSEMGARRMNAFDIISGSPGFNLSGLFGDARKYDRVERFVSAWTAERVVERLEEIVSAENLTVAKKETWGMKIEGQKGNFAMVVEINQLTDELVMIEVRKRQRAAASGRDLWTDTLRPFFVELVHESDQTDPEPTQVHTTS

SEQ ID NO: 224 - protein, 1083 aa, Arabidopsis thaliana
MRFAATVSEKQSEQSVEVTEEFAVTMTEKRSCVHFDKYVDLDKLLKIIKSYQQIKCGECNERVHVKRGSRWGASNRRDWYSSSDQNCARNAIWLCLECGYYVCGDVGLPTEAQSHVMGHNRLTRHRLVIQCKNPQLRWCFSCQSLLPFDNEENGEKKDLLLEVVKLIRERSPNTYSASFETEFSCSGSIYGGIEARDGYAVRGLVNLGNTCFFNSVMQNLLSLDQLREHFLKEDLSVSGPLVSSLKELFAESNSEASVFRNEINPRDLFFSVCSQAPQFRGYQQHDSHELLRCLLDGLSIEESSLRKKLGVSDSNDSSTYQKPTLIDSVFGGEISSTVSCLECGHFSKVYEPFMDLSLPVPSMKLPPKKQQILSQAKEVLKNGAVSKDSEVVSAKPASDHNSTVPLFPSDHKIQSRPETSDNETDLVLLSDVSDTAPSTEAKGVNQILVGSTETLMHDNDRTGKTVPDKEDVRATQSNEETSASGISAVIDEAQVCGCPDLEQSSSSANQGADEELALMVADSQVLYMPYKDHLFYDDYMVAEASSSFVSGDHEPKKDYFDFSSFLDEPEIREGPVFRPLSKSEVYEAGFKADCSDDKTVSAGKGEASSSFISSDHEQNIDYVDFSSFFDEPEISERPFFRPLSKSEVSEAGFKADCSDDKTVSAGKGEASSSFVSSDHEQNIDYVDFSSFFDEPEISERPFFRPLSKSEVSEAGFMAVSGNDKTVRAGKGETFSSFMSGDNERNIDYVEFTNRIFDDRGTSERPVFGPPSKAKVSEAGFVAVSSDSDPAVLDESDSPVSVDRCLAQFTKHEILSEDNAWHCENCSKNLKLQRLREKRRTKEGLSNRWVNENGASSAFDECRDSSLNQSCIDLENGYKAAPPITKLPNCKEEESAIDDGFVGEENTKQAPITSVTETPLLGGETISSQPASDNECENWEDLAVDSEEVIVKRDARKKVLINKAPPVLTIHLKRFSQDARGRVSKLSGHVDFQEFIDLSKYMDTRCSEEDEPVYRLAGLVEHLGAMSRGHYVSYIRGGHKERRDSDTKEPNSSIWYHASDSQVRPASLEEVLRSEAYILFYERI

SEQ ID NO: 225 - protein, 389 aa, Arabidopsis thaliana
MGRAARWFKGIFGMKKSKEKENCVSGDVGGEAGGSNIHRKVLQADSVWLRTYLAETDKEQNKHAIAVAAATAAAADAAVAAAQAAVAVVRLTSNGRSGGYSGNAMERWAAVKIQSVFKGYLARKALRALKGLVKLQALVRGYLVRKRAAETLHSMQALIRAQTSVRSQRINRNNMFHPRHSLERLDDSRSEIHSKRISISVEKQSNHNNNAYDETSPKIVEIDTYKTKSRSKRMNVAVSECGDDFIYQAKDFEWSFPGEKCKFPTAQNTPRFSSSMANNNYYYTPPSPAKSVCRDACFRPSYPGLMTPSYMANTQSFKAKVRSHSAPRQRPDRKRLSLDEIMAARSSVSGVRMVQPQPQPQTQTQQQKRSPCSYDHQFRQNETDFRFYN

SEQ ID NO: 226 - protein, 721 aa, Arabidopsis thaliana
MAYKSLNSITKSDIEALGISGDVSEKLLRDLEDIIHGSSTPPETWIQISRRILHPNLPFSFHQMMYYGCYKDFGPDLPAWIPDPKVASLTNVGKLLEKRGKEFLGGNYKNPVSSFSSFQEFSVSNPEVYWKTVLDELNILFSVPPKCILEKDTSGDNPGGKWLPGAYLNPARNCLTNGFKRRLDDIVIRWRDEGSDDLPVNTMTLLELRSQVWLAAHALSALGLEEESAIAVDMPMNVESVIIYLAIVLAGHVVVSIADSFSPREISTRLKISKAKAIFTQDVIIRGDKSIPLYRRVVDAEAPLAIVVPARGSSCRMKLREKDLSWNNFLGNARNLRGVEYVAAEKPAGAYTNILFSSGTTGEPKAIPWTNISPLKSAADAWCHLDVQRGDVVAWPTNLGWMMGPWLVYASLINGACMGLYNGSPLGPTFAKFVQDAEVSVLGVIPSIVRTWQNSNSTSGYDWSRIRCFGSTGEASNIDEYLWLMGRAHYKPVIEYCGGTEIGGSFISGSLLQPQSLAAFSTAAMGCKLFILDEDSNPIPPYAAGVGELALCPHMFGASSTLLNGNHFKVYFQGMPTFQGQILRRHGDLFERTSKGYYRAHGRADDTMNLGGIKVGSIEIERVCNSVDDSVLETAAIGVPPPSGGPEQLVIAVVFKSPEFSNPDLNLLKKSFNSEIQKKLNPLFKVSSVVTLPSLPRTATNKVMRRVLRQQLTQTGLNSKL

SEQ ID NO: 227 - protein, 666 aa, Arabidopsis thaliana
MDSTFRDEDLVEEREELMVSYSENNSRPIMKKAHFLKPFVTSSIDGFQGMLRPSPSPELKASSLSVSFRGWRLPNKKFQFWVKKMVALHKPTWLKSGIFEAIKASTYRIHKNPSLILSLAQNWCPETNTFVFPWGEATITLEDVNVLLGFSISGSSVFASLQSSEMKEAVEKLQKRCQGSMKQESWISSFVDDEMEHEAFLVLWLSKFVFPDKFCSSISSDVFPLAVRLARGERIAFAPAVLANLYNDLGHICVLASIQNVLASSLFKLVQVWIWERFKSIRPEAKVIPRGQPRIAQWSGLKQRFKNVGLIIFHGNFDWRPYSEPLENWNPPRFYVEEAKWVRIDESLDGDYDDDDEFVSFARCVRVSKLVGIGVVENYYPNRVAMQFGLAQDVPVLGTNHRRNFTEEEAWDDYNKPLVGLKLYFPSRVATASVTTRYRDWWAKSVSEMRKESMETFNVSSTVDHYDDSDDDIPLKIVPLSQVYQKLDDEMKKAKHSTNKRRKRAREDDESAAETEDDESADTEDDESADTEDDESAETEDDDNMTIAQRINSRKKSDDIENTEGERSRLVADNNVSGLPQKLAYGDETVATTQEETEQKNNENKSSNGVAAEKEEDDERLKQRKLAIKELALKTEARMLKVENTLAKIKQWKLTRLHTKKPLVSS

SEQ ID NO: 228 - protein, 213 aa, Arabidopsis thaliana
MQFSRNSILRQLSRKEGWRSASKRWTSGDSSTAFNDDTSGGGYSSMEGLYGVYSGGDTAARSKRVMVVVDESSRSKHAMMWALTHLTNKGDLVTLLHVVSPDDEATPSLAQSLGSLCKACKPEVDVEALVIQGPKLATVLSQVKKLEVSVLVLGQKKSAPLISCLCGPSRSEELVNRCINGADCLTIGVRKQCKGVGGYLINTRWQKNFWLLA

SEQ ID NO: 229 - protein, 183 aa, Arabidopsis thaliana
MADVRTHSHQLQVHPQRQHEGGIKVLYPQSGPSSTQVLAVFVGVPIGGTLLTIAGLTLAGSVIGLMLAFPLFLIFSPVIVPAAFVIGLAMTGFLASGAIGLTGLSSMSWVLNYIRRAGQHIPEELEEAKHRLADMAEYVGQRTKDAGQTIEDKAHDVREAKTFDVRDRDTTKGTHNVRDTKTT

SEQ ID NO: 230 - protein, 135 aa, Arabidopsis thaliana
MEGKTVIFSVLVMGLVISQIQVEAQKTCCPSQSTRKEFEDCISEGNLQILCSAESGCRDTYVGYCPSGFPYGSLTNSGDVVNVYCKLGCVSSLCGALTSLQKLDTSGKVNVAVERCTKACSTICTKGSKTAVETV

SEQ ID NO: 231 - protein, 478 aa, Arabidopsis thaliana
MTTVVSFLALFLFLVAAVSGDVIKLPSLASKFFRPTENDDDSTKWAVLVAGSSGYWNYRHQADVCHAYQLLKKGGVKEENIVVFMYDDIAKNEENPRPGVIINSPNGEDVYNGVPKDYTGDEVNVDNLLAVILGNKTALKGGSGKVVDSGPNDHIFIYYSDHGGPGVLGMPTSPNLYANDLNDVLKKKYASGTYKSLVFYLEACESGSIFEGLLPEGLNIYATTASNAEESSWGTYCPGEDPSPPSEYETCLGDLYSVAWIEDSEKHNLQTETLHEQYELVKKRTAGSGKSYGSHVMEFGDIGLSKEKLVLFMGTNPADENFTFVNENSIRPPSRVTNQRDADLVHFWHKYQKAPEGSARKVEAQKQVLEAMSHRLHVDNSILLIGILLFGLEGHAVLNKVRPSGEPLVDDWDCLKSLVRAFERHCGSLSQYGIKHMRSIANMCNAGIQMRQMEEAAMQACPTIPTSPWSSLDRGFSA

SEQ ID NO: 232 - protein, 212 aa, Arabidopsis thaliana
MSRALSVVCVLLAISFVCARARQVPGESDEGKTTGHDDTTTMPMHAKAADQLPPKSVGDKKCIGGVAGVGGFAGVGGVAGVGGLGMPLIGGLGGIGKYGGIGGAAGIGGFHSIGGVGGLGGVGGGVGGLGGVGGGVGGLGGVGGLGGAGLGGVGGVGGGIGKAGGIGGLGGLGGAGGGLGGVGGLGKAGGIGVGGGIGGGHGVVGGVIDPHP

SEQ ID NO: 233 - protein, 490 aa, Arabidopsis thaliana
MAETTSWIPVWFPLMVLGCFGLNWLVRKVNVWLYESSLGENRHYLPPGDLGWPFIGNMLSFLRAFKTSDPDSFTRTLIKRYGPKGIYKAHMFGNPSIIVTTSDTCRRVLTDDDAFKPGWPTSTMELIGRKSFVGISFEEHKRLRRLTAAPVNGHEALSTYIPYIEENVITVLDKWTKMGEFEFLTHLRKLTFRIIMYIFLSSESENVMDALEREYTALNYGVRAMAVNIPGFAYHRALKARKTLVAAFQSIVTERRNQRKQNILSNKKDMLDNLLNVKDEDGKTLDDEEIIDVLLMYLNAGHESSGHTIMWATVFLQEHPEVLQRAKAEQEMILKSRPEGQKGLSLKETRKMEFLSQVVDETLRVITFSLTAFREAKTDVEMNGYLIPKGWKVLTWFRDVHIDPEVFPDPRKFDPARWDNGFVPKAGAFLPFGAGSHLCPGNDLAKLEISIFLHHFLLKYQVKRSNPECPVMYLPHTRPTDNCLARISYQ

SEQ ID NO: 234 - protein, 461 aa, Arabidopsis thaliana
MCLPFRPVSKTYYSSSSSTIVTRMVNCILLFVFILLVYLLISASRLQSKNSIHAYFSSSDQDQSQSPTKIEHIVFGIGSSAISWRARREYVKLWWDAQKMRGCVFVERPLPSSQNHTDSYLLPPVCVSQDTSRFRYTWRGGDRNAIRIARCVLETVRLFNTSSEEVRWYVFGDDDTIFIPENLARTLSKYDHTSWYYIGSTSEIYHQNSMFGHDMAFGGGGYALSSSLANVLARNFDSCIERYPHLYGGDSRVYACVLELGVGLSKEPGFHQFDVRGNALGILTSHSTRPLVSLHHMAHIDPIFPNSTTFSAVRHLFSAVQLDPLRIFQLSVCYDRWYSWTISVSWGYTVQIDGRHLFLRDVLRAQETFRPWQKSGGLASVYTFNTREIHRDPCQRPVTFYMQHVSSSSHDGTIKSVYKQAYENCTYDPVTSPRKIHEIRVFSRRLDPNIRQQSPLEKIIF

SEQ ID NO: 235 - protein, 548 aa, Arabidopsis thaliana
MAARATFIFYALFLTTLQFLLTHHVSSAARGLWKYIAPNVGISAMHMQLLHNDRVVMYDRTNFGPSNISLPNGNCRDNPQDAVSKIDCTAHSIEYDVATNTIRPLTVQSNTWCSSGSVRPDGVLVQTGGDRDGELKTRTFSPCNNNQCDWVEMNNGLKKRRWYASNHILPDGKQIVMGGQGQFNYEFFPKTTNPNVVALPFLAETHDQGQENNLYPFVFMNTDGNLFMFANNRAILLDYVKNTVVKTFPAIPGGDPRNYPSTGSAVLLPLKNLEADNVETEVLVCGGAPKGSYNLARKKTFVKALDTCARIKINDAKPEWAVEKMPHARVMGDMIPLPNGDVLLINGGSFGTAAWELGRTPVLAPDLYHPENPVGSRFESLRPTTIPRMYHSAAILLRDGRVLVGGSNPHAFYNYTGVLFPTELSLEAFSPVYLQREFSNLRPKIISPEPQSMIKYGTNLKLKFSVTGEVTTPAKVTMVFPTFTTHSFAMNQRVLVLDNVKFTRKGKSPMYEVQVRTPRSANIAWPGYYMIFVVNQDIPSEGVWVKLE

SEQ ID NO: 236 - protein, 554 aa, Arabidopsis thaliana
MDHKILLTPPKSLYTKCIITIIYVVSISHLNAHFITSCKQTPYPSVCDHHMSNSPLKTLDDQTDGFTFHDLVVSSTMDQAVQLHRLVSSLKQHHSLHKHATSALFDCLELYEDTIDQLNHSRRSYGQYSSPHDRQTSLSAAIANQDTCRNGFRDFKLTSSYSKYFPVQFHRNLTKSISNSLAVTKAAAEAEAVAEKYPSTGFTKFSKQRSSAGGGSHRRLLLFSDEKFPSWFPLSDRKLLEDSKTTAKADLVVAKDGSGHYTSIQQAVNAAAKLPRRNQRLVIYVKAGVYRENVVIKKSIKNVMVIGDGIDSTIVTGNRNVQDGTTTFRSATFAVSGNGFIAQGITFENTAGPEKHQAVALRSSSDFSVFYACSFKGYQDTLYLHSSRQFLRNCNIYGTVDFIFGDATAILQNCNIYARKPMSGQKNTITAQSRKEPDETTGFVIQSSTVATASETYLGRPWRSHSRTVFMKCNLGALVSPAGWLPWSGSFALSTLYYGEYGNTGAGASVSGRVKWPGYHVIKTVTEAEKFTVENFLDGNYWITATGVPVNDGL

SEQ ID NO: 237 - protein, 920 aa, Arabidopsis thaliana
MADQSLLHSPINPHFFQPILTESRTHLNIPVAFFSKHVEGRNNQNKTVTLRSDASDKTWLVKMDGLKLTDGWEDFAFAHDLRTGDIVVFRLEGEMVFHVTALGPSCCEIQYHTSSHNINDDDRNDQINIASRNSSRVKKNPRKKVESSLDHSRFVAKVSAWCLSNDRLYIPLSFARLNGLNKINSKKIYLQNEEGRSWKLVLRHDKSGMQTFVQSGWRRFCSENGIRQGQYTFKLVRKSAPPVIRLCRAKAKPKQRSVAEYSSDHSCFEGSVTPSSLRNDLLYLPRSFVNSNRLDKRCSEIVLKNEQGVKWPLVLKRFKSVTYLPKGWTSFCQVNRIKAGDSFKFKLVGTWKKPVLSLCPTQSNNHKTPLECSEGNKSEESEEDCLEVKKKKYWSRCRASVENMDDDQTNIGNSSRKKRVSKNPREKVESSSDHSSFVGSVNPSSLYKDQLYLPRNFVSSNFLDKRCSEIVLKNERGEKRTLVLKHFKKDLTFLKKGWTSFCQVNRIKAGDSFKFKLVGTWNKPVLSLCPTETNYHKTPLACSEGNKSEESEEEGTEDKNTSQDCLEVKKRKYWSTCRASAENIDDDQTNIGNSSKEKRVKKNPVKKAESSSDHSSFVANVTASSLNYDRLYLPLSFVSSNGLDKMNGKEIVLLNEEGLSWKFNLKYNQAGKHTYVRPGWSRFCDANGMSQGQQFTFKLVQKHGPPVMYLSLSEHRPKSESSSHRSYFVGSVTASSIKKDKLYLWKSFVSSNGLDKGCKKIILKNKWGREWKLVLKHYKSNCFTIIKRGWTSFCQGNGLKAGDSFKFKLVGTGEKPVLSLCPAESSHEKIPLECPEGIDDVNSLSSNPSSGDDSSRSEESEEENMEDKNISQDCLETKKRKYCSSSSYSQNRFVTLTLTRSAFQTYKLVSFFNNYASRLS

SEQ ID NO: 238 - protein, 403 aa, Arabidopsis thaliana
MASLDSLPAMKLVRFILSTLLVTSVNSQTQCRNFKSIISFGDSIADTGNLLGLSDPNDLPASAFPPYGETFFHHPTGRYSDGRLIIDFIAEFLGFPLVPPFYGCQNANFKKGVNFAVAGATALEPSFLEERGIHSTITNVSLSVQLRSFTESLPNLCGSPSDCRDMIENALILMGEIGGNDYNFALFQRKPVKEVEELVPFVIATISSAITELVCMGGRTFLVPGNFPIGYSASYLTLYKTSNKEEYDPLTGCLKWLNDFSEYYNKQLQEELNGLRKLYPHVNIIYADYYNALLRLFQEPAKFGFMNRPLPACCGVGGSYNFNFSRRCGSVGVEYCDDPSQYVNYDGIHMTEAAYRLISEGLLKGPYAIPPFKWSCLSSEIMNKMSLDTQILDEQLLQGCLKV

SEQ ID NO: 239 - protein, 383 aa, Arabidopsis thaliana
METVVVIVGAGPAGLATSVCLNQHSIPNVILEKEDIYASLWKKRAYDRLKLHLAKEFCQLPFMPHGREVPTFMSKELFVNYLDAYVARFDINPRYNRTVKSSTFDESNNKWRVVAENTVTGETEVYWSEFLVVATGENGDGNIPMVEGIDTFGGEIMHSSEYKSGRDFKDKNVLVVGGGNSGMEISFDLCNFGANTTILIRTPRHVVTKEVIHLGMTLLKYAPVAMVDTLVTTMAKILYGDLSKYGLFRPKQGPFATKLFTGKAPVIDVGTVEKIRDGEIQVINGGIGSINGKTLTFENGHKQDFDAIVFATGYKSSVCNWLEDYEYVMKKDGFPKAPMPKHWKGEKNLYCAGFSRKGIAGGAEDAMSVADDIRSILATLKNN

SEQ ID NO: 240 - protein, 74 aa, Arabidopsis thaliana
MANIVGNTSVSTRFKELIREMTQLNEEIQKIDVNDFRAIREARKKITGMTTKLDELLEMMKETVKEKKETPHPE

SEQ ID NO: 241 - protein, 832 aa, Arabidopsis thaliana
METNPRKLRSYSYICLIVCIFVLVVCAILSRAEEKEGKGENDDHIPKIYSILVEGEPLAFRASTNINSKAMALEAKKIEEIHDEILGSTLEKGSYTKLYSFKHVINAIAVRTTASQAKKLGKTKGVKAVEEDKGVKLMTTYTPDFLELPQQVWQKISNEGDRRAGEDIVIGFVDTGINPTHPSFAALDLTNPYSSNLSRLHFSGDCEIGPFFPPGSCNGKIISARFFSAGARASGALNSSLDILSPFDASGHGSHVASIAAGNAGVPVIVDGFFYGRASGMAPRSRIAVYKAIYPSIGTLVDVIAAIDQAIMDGVDVLTLSVGPDEPPVDKPTVLGIFDLAMLLARKAGVFVVQAVGNNGPSPSSVLSYSPWVVGVAAGNTDRSYPAPLILDGGQTVQGVGLSGPTLGAPLVQHRLVLAKDAVRTNGSVLQPLTRDIEECQRPENFDPAAVFGSIVICTFSDGFYNQMSTVLAITQTARTLGFMGFILIANPRFGDYVAEPVIFSAPGILIPTVSAAQIILRYYEEKTFRDTRGVATQFGARARIGEGRNSVFAGKAPVVSRFSSRGPAFIDATRSPLDVLKPDILAPGHQIWGAWSLPSAFDPILTGRSFAILSGTSMATPHIAGIGALIKQLNPSWTPAMIASAISTTANEYDSNGEIISAEYYELSRLFPSNHFDHGAGHVNPARALDPGLVLPAGFEDYISFLCSLPNISPATIRDATGVLCTTTLSHPANLNHPSVTISALKESLVVRRSFQDVSNKTETYLGSVLPPNGTTVRLTPTWFTVPPQKTQDLDIEFNVTQVLNKFTFGEVVLTGSLNHIIRIPLSVKTI

SEQ ID NO: 242 - protein, 277 aa, Arabidopsis thaliana
MQQVLKQLEPWCELKDKVVLVTGASSGIGREICLDLCKAGCKIVAAARRVDRLNSLCSEINSFGAIGVQAAALELDVSSDADTIRKAVKEAWEIFGTIDVLINNAGIRGNVKSSLDLSKEEWDKVFRTNLTGSWLISKYVCLLMRDAKRGGSVINVSSISGLHRGLLRGGLAYACSKGGVDTMTRMMAIELAVYKIRVNSIAPGIFRSEITQGLFQKEWLEKVTEKIVPLKMQQTVDPGLTSLVRYLIHDSSQYVTGNTYIVDSGATLPGVPIFSSL

SEQ ID NO: 243 - protein, 276 aa, Arabidopsis thaliana
MQVLKQLEPWCELKDKVVLVTGASSGIGREICLDLCKAGCKIVAAARRVDRLNSLCSEINSFGAIGVQAAALELDVSSDADTIRKAVKEAWEIFGTIDVLINNAGIRGNVKSSLDLSKEEWDKVFRTNLTGSWLISKYVCLLMRDAKRGGSVINVSSISGLHRGLLRGGLAYACSKGGVDTMTRMMAIELAVYKIRVNSIAPGIFRSEITQGLFQKEWLEKVTEKIVPLKMQQTVDPGLTSLVRYLIHDSSQYVTGNTYIVDSGATLPGVPIFSSL

SEQ ID NO: 244 - protein, 278 aa, Arabidopsis thaliana
MQKQVLKQLEPWCELKDKVVLVTGASSGIGREICLDLCKAGCKIVAAARRVDRLNSLCSEINSFGAIGVQAAALELDVSSDADTIRKAVKEAWEIFGTIDVLINNAGIRGNVKSSLDLSKEEWDKVFRTNLTGSWLISKYVCLLMRDAKRGGSVINVSSISGLHRGLLRGGLAYACSKGGVDTMTRMMAIELAVYKIRVNSIAPGIFRSEITQGLFQKEWLEKVTEKIVPLKMQQTVDPGLTSLVRYLIHDSSQYVTGNTYIVDSGATLPGVPIFSSL

SEQ ID NO: 245 - protein, 546 aa, Arabidopsis thaliana
MEGTMRCSANYVPLSPISFLERAAVVFGSRTSVVYGDIQYTWHQTRDRCVRLASALSDLGLSRHDVVAALAPNVPALCELYFGAPMAGAVLCVLNTTFDSQMLAMALEKTKPKVFFVDSEFLSVAEESLSLLSNIEEKPLIITITENPTEQSKYEQYEDFLSTGNPNFKPIRPVDECDPIALNFTSGTTSTPKCVVYSHRGAYLNATAVGVMNEMKPMPVYLCTVPMYHCSGWCYIWTVTAFGGVIVCLREVNDEVIFDSIVKHKVTNFGGSPPVLNMIANARDSVKKSFPWTVQVMSGGSSPPEVMLKLKKLGFKVMMAYGCSEVYGLGTACLWMPEWETLPEEESLRLKARDGLNHFAKEAVDVLDPTTMKSVPHDGKTIRVIALRGNTVMSGYFKDKEATEAAFRGGWYWSRDMGVIDPDGYIQFKDRSQDVITCGGEIVGSKEIEGILYSHPAVYDAGVVGRPDETLGESMCAFVKLKEGAEAREEEIIEFCKRKLGNKNMKMIPKTVVFSDVPKTPTGKIRKNVLRKMAKDMGYVQLRAVE

SEQ ID NO: 246 - protein, 455 aa, Arabidopsis thaliana
MTFNKRQVKINHWPEKNDKEKQKYSKNRETVKLTLLTLLLLCSICFLFLTLNFPFTIEFTASIPRTCDHNFTVYVYDLPKEFNIGLLQNCRHLNIYTNMCPHVANNGLGQPLHRGRTSWFSTHQFIAEMIFHARVENHPCRTYEPDTADIFYVPFYGGLYASSVFREQNLTKRDELAVRLVNYISGQRWWKRSNGRDHFLAIGRTAWDFMRSSDTDFGANMLMQMPRVMNMSVLTVERQPWNGDNHFGIPYPSYFHPYTSAEMVTWQDKMKNVERPNLFSFVGGPRKGLEKAAIRDELIKQCAESSHCELLKCENGGSRCHNPMTVLGVMARSRFCLQAPGDSFTRRSTFDAMLAGCIPVFFSPHTMYTQYMWYLPDDKRSYSVFMDEKNNTHIEQELLRISENEVVQMREIVIDLIPRLTYAHPNSTNYDLPDAVDIALEALAKQARDNVVVSL

SEQ ID NO: 247 - protein, 374 aa, Arabidopsis thaliana
MNTNRKKMKVHIGGYVLILALTVSVILQQPELVTGQARVPAMFVLGDSLVDAGNNNFLQTVARANFLPYGIDMNYQPTGRFSNGLTFIDLLARLLEIPSPPPFADPTTSGNRILQGVNYASAAAGILDVSGYNYGGRFSLNQQMVNLETTLSQLRTMMSPQNFTDYLARSLVVLVFGSNDYINNYLMPNLYDSSIRFRPPDFANLLLSQYARQLLTLYSLGLRKIFIPGVAPLGCIPNQRARGISPPDRCVDSVNQILGTFNQGLKSLVDQLNQRSPGAIYVYGNTYSAIGDILNNPAAYGFSVVDRACCGIGRNQGQITCLPLQTPCPNRNQYVFWDAFHPTQTANSILARRAFYGPPSDAYPVNVQQMTLLH

SEQ ID NO: 248 - protein, 319 aa, Arabidopsis thaliana
MEKEADNKFRWVIKNFSSLGSERVFSDIFVVGSCKWRLMAYPKGVRDNRCFSLFLVVTDFKTLPCDWKRHTRLRLNVVNQLSEELSILKETQMWFDQKTPAWGFLAMLPLTELKAENGGFLVNEEVKIVVEVDVVEALGKLEESEEATQPLKKVKLEAFVESKGLLKETSSVKEEIIDVNVFHVLPSQVEFVSRVFERYPEIASIFQAKKQHLRTACMYVLLSLIETLCKSLEELSNDDLVGGDNALQYLKFSGFKVDWLEKKLEEVKEKKKEEQIGETRMQEMKVFKQKCSDIEALMEREKSKLLVTRGSPLTLDDVL

SEQ ID NO: 249 - protein, 767 aa, Arabidopsis thaliana
MWRLKIGAKGGDETHLFTTNNYTGRQTWEFDADACSPEELAEVDEARQNFSINRSRFKISADLLWRMQFLREKKFEQKIPRVEIGDAENITYKDAKTALRRGILYFKALQAEDGHWPAENSGCLFFEAPFVICLYITGHLEKILTLEHRKELLRYMYNHQNEDGGWGIHVEGQSAMFCTVINYICLRILGVEADLDDIKGSGCARARKWILDHGGATYTPLIGKAWLSILGVYDWSGCKPIPPEVWMLPTFSPFNGGTLWIYFRDIFMGVSYLYGKKFVATPTPLILQLREELYPQPYDKILWSQARNQCAKEDLYYPQSFLQEMFWKCVHILSENILNRWPCNKLIRQKALRTTMELLHYQDEASRYFTGGCVPKPFHMLACWVEDPDGDYFKKHLARVPDYIWIGEDGLKIQSFGSQLWDTAFSLQVMLAYQDVDDDDDEIRSTLIKGYSFLNKSQLTQNPPGDHRKMLKDIAKGGWTFSDQDQGWPVSDCTAESLECCLVFGSMPSELIGEKMDVERLYDAVNLLLYFQSKNGGITVWEAARGRTWLEWLSPVEFMEDTIVEHEYVECTGSAIVALARFLKEFPEHRREEVEKFIKNAVKYIESFQMPDGSWYGNWGVCFMYGTFFAVRGLVAAGKTYQNCEPIRKAVQFILETQNVEGGWGESYLSCPNKKYTLLEGNRTNVVNTGQALMVLIMGGQMERDPLPVHRAAKVLINSQLDNGDFPQEEIMGVFKMNVMVHYATYRNIFTLWALTYYTKALRVPLC

SEQ ID NO: 250 - protein, 570 aa, Arabidopsis thaliana
MKRFNYGFFHLVLFLISLLLLGSGICMDPFSYDQSLKSECLMEPPQTTANTGGEGVKELKINENGGIRNVVEGVDLREGNIYITSAWVKLRNESQRKVGMTFSEKNGRNVFGGEVMAKRGCWSLLKGGITADFSGPIDIFFESDGLAGLEISVQNVRMQRFHKTQWRLQQDQVIEKIRKNKVRFQMSFKNKSALEGSVISIEQIKPSFLLGCAMNYRILESDSYREWFVSRFRLTSFTNEMKWYATEAVRGQENYKIADSMMQLAEENAILVKGHTVLWDDKYWQPNWVKTITDPEDLKNVTLNRMNSVMKRYKGRLIGWDVMNENVHFNYFENMLGGNASAIVYSLASKLDPDIPLFLNEFNTVEYDKDRVVSPVNVVKKMQEIVSFPGNNNIKGGIGAQGHFAPVQPNLAYMRYALDTLGSLSFPVWLTEVDMFKCPDQVKYMEDILREAYSHPAVKAIILYGGPEVSGFDKLTLADKDFKNTQAGDLIDKLLQEWKQEPVEIPIQHHEHNDEEGGRIIGFSPEISLLHGHYRVTVTNPSMKNLSTRFSVEVTKESGHLQEVQLVIDA

SEQ ID NO: 251 - protein, 187 aa, Arabidopsis thaliana
MTRGMIPTKAKVVVISLIWAILVLESATVSSAVEDLVVEQCKHNCKHDIHNKKKECEDKCNELLMMEIEKETSGRQEEEHNPFCEAFCNPFEGLFQHCMAVCPRTKSKPEMMVIGGEGVANEGLQTKCNRKCLSYTEPEAYKKCISGCFMSNEEVCETSCSILQEEPLTIRCMRICHERIPGVVAST

SEQ ID NO: 252 - protein, 121 aa, Arabidopsis thaliana
MRKSISIAFVIAITIFMSHLNVFTVYSLTPCEEATNLLTPCLRYLWAPPEAKPSPECCSGLDKVNKGVKTYDDRHDMCICLSSEAAITSADQYKFDNLPKLCNVALFAPVGPKFDCSTIKV

SEQ ID NO: 253 - protein, 451 aa, Arabidopsis thaliana
MPIHIGSSIPLMVEKMLTEMVKPSKHIPQQTLNLSTLDNDPYNEVIYKACYVFKAKNVADDDNRPEALLREALSDLLGYYYPLSGSLKRQESDRKLQLSCGGDGGGVPFTVATANVELSSLKNLENIDSDTALNFLPVLHVDIDGYRPFALQVTKFECGGFILGMAMSHAMCDGYGEGHIMCALTDLAGGKKKPMVTPIWERERLVGKPEDDQPPFVPGDDTAASPYLPTDDWVTEKITIRADSIRRLKEATLKEYDFSNETITTFEVIGAYLWKSRVKALNLDRDGVTVLGLSVGIRNVVDPPLPDGYYGNAYIDMYVPLTAREVEEFTISDIVKLIKEAKRNAHDKDYLQEELANTEKIIKMNLTIKGKKDGLFCLTDWRNIGIFGSMDFGWDEPVNIVPVVPSETARTVNMFMRPSRLESDMVGGVQIVVTLPRIAMVKFKEEMEALE

SEQ ID NO: 254 - protein, 250 aa, Arabidopsis thaliana
MSRGRGVPMMDLKRSYDVEDRVVSVSIPSIIEADEADLWPLPEIDTKKSKFPCCIVWTPLPVVSWLAPFIGHIGLCREDGVILDFAGSNFINVDDFAFGPPARYLQLDRTKCCLPPNMGGHTCKYGFKHTDFGTARTWDNALSSSTRSFEHKTYNIFTCNCHSFVANCLNRLCYGGSMEWNMVNVAILLMIKGKWINGSSVVRSFLPCAVVTSLGVVLVGWPFLIGLSSFSLLLFAWFIIATYCFKNIIT

SEQ ID NO: 255 - protein, 573 aa, Arabidopsis thaliana
MVLFTLSTTSSSSSKLKQHSHQSFSESLMEHTIEDAESIIHRWISPEHVHSSSFCFISSLFSTENREEAKRFIDAVTTLHSGMIRLISVNPTSMKLVKAENLMRISMTHLSKEFYRILKSNRRYLDPESVSIRSSKASDSDSDSDSNTMDDLKMIADCMISSGYSKECFKIYKRIRKSIINEALNQLGFENLTFSQIQKLEWEVMEKKIRKWLRTTTRAVNTLFSGEQILSDHVFSSSSSTIRESAFAEITSQTALALFTFPEKMAKCRKSPEKIFLTLDVYQTIVDLLPKINELFSSDSTSTVRSQVDLTLVNLREGVVSMIDEFESSISKESSKSLISGGGIHQLTRYVMNFIVFLADYSDTLSDIISKPSLPSPEEEKDSGDSSPVKSRISRLILFLLCKIDAKSRLYNDVALSYLFLINNVNYVVVKVRSSNLKTVLSEDWVKKHEAKVKKYVAKFEEIVWGEMMTSLSDDVTMTAEEGIKRFSDGFEEAYKRQTGWIVPDSKLRDEIKRSVGMMIIPRYSGFCERNRVRLLENVGFDPEDIGNYLSDLYFGSGGSGSGSSVHSSGSSV

SEQ ID NO: 256 - protein, 376 aa, Arabidopsis thaliana
MMKLLLVVATSVALIFSVTDLSGEGPKHGGESMLTVQIPDFRLIPTTGALGPESFVFDFFGDGPYTGLSDGRIVKWLANESRWIDFAVTTSAREGCEGPHEHQRTEHVCGRPLGLAFDKSTGDLYIADAYMGLLKVGPTGGVATQVLPRELNEALRFTNSLDINPRTGVVYFTDSSSVYQRRNYIGAMMSGDKTGRLMKYDNTKQVTTLLSNLAFVNGVALSQNGDYLLVVETAMCRILRYWLNETSVKSQSHDNYEIFAEGLPGFPDNIKRSPRGGFWVGLNTKHSKLTKFAMSNAWLGRAALGLPVDWMKVHSVWARYNGNGMAVRLSEDSGVILEVFEGKNENKWISISEVEEKDGTLWVGSVNTPFAGMYKI

SEQ ID NO: 257 - protein, 224 aa, Arabidopsis thaliana
MEKVGEDEEKTIEEANNSTEETKSDKEEERIKGTIADQVDPVDSTEEGSTGPSNSHTVVSKDHDFSESDMEDEEQVLEFFRRNHGFSPEVTKRNNFPYVNNSERMVLQFQEDTSAETEQTNEMFHSLNDSNEILEGTKSSSASDEDTEDSSSNSDLDSSLSRYYFDGSLPVSAHVEEFETHQDESLVPKDENQMPLLCLKQPMLQPTSWRNCCGLLELLWAADP

SEQ ID NO: 258 - protein, 585 aa, Arabidopsis thaliana
MDVMKLDHDSVLKELERITSKAAEVQDNILRGILERNKDTEYLSKYMNGSKDVLEFKRAVPIIIYKDIYPYIQRIANGEDSSLITGHSITEILCSSGTSAGEPKLMPTIPEDLDRRTFLYNLIIPIVNKYITGLDKGKAMYLNFVKAETSTPCGLPIRAVLTSYYKSKHFQCRPYDPFNDLTSPIQTILCEDSNQSMYCQLLAGLIHRHKVMRLGAVFASAFLRAISYLEKKWSQLCEDIRTGSLNPMITDPGCQMAMSCLLMSPNPELASEIEEICGRSSWKGILCQLWPKAKFIEAVVTGSMAQYIPALEFFSQGKIPLVCPMYASSETYFGVNVEPLSKPSDVVFTLLPNMCYFEFIPLGKNGTLSFDLDDDEQVPCDKVVDLVNVKLGRYYELVVTTFAGLYRYRIGDVLQVAGFYNGAPQFRFICRRNVVLSIDLDKTNEEDLHRSITLAKKKLGSNAFLAEYTSYADTSSVPGHYVLFWEIQGHLEPKLMEECCVAVEEELDYIYRQCRTKERSIGALEIRVVKPGTFEKLMDLIISQGGSFNQYKTPRCVKSNSATFKLLNGHVMASFFSPRDPTWVP

SEQ ID NO: 259 - protein, 333 aa, Arabidopsis thaliana
MVLLLVIVGLISYYVYKSITPPPPIPLPENVSEISPRIKLNDGRHLAYKELGFPKDKAKNKIIIVHGNGNSKDVDLYITQEMIDEFKIYFLFFDRAGYGESDPNPTRTLKTDTYDIEELADKLQVGPKFHVIGMSLGAYPVYGCLKYIPNRLSGASLVVPLVNFWWSRVPQNLLNAAMKKLPIGFQLTLRVAHYSPWLLYWWMTQKWFPNSRNPKDTMTERDLELAEKHTKHSYIKESALRQGGYVTTQQDIIAGYGNWEFDPTELKNPFSDSNKGSVHMWCALEDKQISRDVLLYICDKLPWIKLHEVPDGGHYIIHEKRHFEAIIKAACSD

SEQ ID NO: 260 - protein, 227 aa, Arabidopsis thaliana
MMEVLLRLLVTQVILLALATSFVSCYDPNPLQDFCVAASETNRVFVNGKFCKDPKSVTANDFSYSGLNIARNTTNFLGSNVTTVDVNKIPGLNTLGVSLARLDFAQGGQNPPHIHPRATEILVVTKGKLLVGFVSSNQDNNRLFYKVLKRGDVFVFPIGLIHFQMNVRRTRAVAFAGFGSQNPGTIRIADAVFGSNPSIPQEVLAKAFQLDVKLVRFLHIVFGPPLW

SEQ ID NO: 261 - protein, 125 aa, Arabidopsis thaliana
MSTKKIMLKSSDGKMFEIEEETARQCQTIAHMIEAECTDNVIPVSNVTSEILEMVIEYCNKHHVDAANPCSDEDLKKWDKEFMEKDQYTIFHLMNAAYDLHIKSLLALAYQTVADMVNDNKWAFE

SEQ ID NO: 262 - protein, 486 aa, Arabidopsis thaliana
MAITNKLIITLLLLISIAVVHCLSFRVEIDEFEPPQQGEQEGPRRRPGGGSGEGWEEESTNHPYHFRKRSFSDWFQSKEGFVRVLPKFTKHAPALFRGIENYRFSLVEMEPTTFFVPHHLDADAVFIVLQGKGVIEFVTDKTKESFHITKGDVVRIPSGVTNFITNTNQTVPLRLAQITVPVNNPGNYKDYFPAASQFQQSYFNGFTKEVLSTSFNVPEELLGRLVTRSKEIGQGIIRRISPDQIKELAEHATSPSNKHKAKKEKEEDKDLRTLWTPFNLFAIDPIYSNDFGHFHEAHPKNYNQLQDLHIAAAWANMTQGSLFLPHFNSKTTFVTFVENGCARFEMATPYKFQRGQQQWPGQGQEEEEDMSENVHKVVSRVCKGEVFIVPAGHPFTILSQDQDFIAVGFGIYATNSKRTFLAGEENLLSNLNPAATRVTFGVGSKVAEKLFTSQNYSYFAPTSRSQQQIPEKHKPSFQSILDFAGF

SEQ ID NO: 263 - protein, 352 aa, Arabidopsis thaliana
MGKTDGSSWFTAVKNVFRSPEKLIPRRINRRQDNDLVEEVEDELHQRPKRRKRRWLFKKVSSDPCAINVGINTTSTAINAIAAEETEKTVSPAAKETVFFCRTSVYLKRHVAAILIQTAFRGCLARTAVRALKGVVKLQALVRGHNVRRRTSITLQRVQALVRIQALALDHRKKLTTKLGDEISYSHAFSKQMWRTMEREAHSESELEDKRPSRLNGYGYQETGRRMSTDQAIVEPVKIVEIDKYNNTYSHHQQLNDQTPRGNSFVTRQAHSIPNYMSTTASTVARFRRPQSVPKQRSNRTCLDNNEPRLRLVRKRLSFHNDNPQSYGYIAGDGYFWYDIDKRTNAHEDFQY

SEQ ID NO: 264 - protein, 289 aa, Arabidopsis thaliana
MIQLYAEKLAELDMMVRRLILESYGIEYFIDEHLNSTYYRMRLMKYIARPDNDITAAVGANVDNGANDNADGDANVNDDGASIGVKVNVDVGDDVNDNDSVNIGVGVDINVETNVNGDLDAEANGDATAWVVGAVSGNASVGAKEANVDAELGLPSHTDKSLTGIIYQHQIDGLEVKTKEGKWIRVKPAPNTVIVIAGDALCALMNGRIPSPYHRVRVTEKKKTRYAAALFSNPKEGYIIDSPKELVDEKHPRAFKPFDFVDLFNFYHTEAGRRAPSTLQAFCGVSAGK

SEQ ID NO: 265 - protein, 361 aa, Arabidopsis thaliana
MELQGSVLKAMQELFALPTEAKQRNVCPKPFTGYLSHNGLSESFGIKDANILEKAHEFTQQLWPEGNKSISKMIQLYAEKLAELDMMVRRLILESYGIEYFIDEHLNSTYYRMRLMKYIARPDNDITAAVGANVDNGANDNADGDANVNDDGASIGVKVNVDVGDDVNDNDSVNIGVGVDINVETNVNGDLDAEANGDATAWVVGAVSGNASVGAKEANVDAELGLPSHTDKSLTGIIYQHQIDGLEVKTKEGKWIRVKPAPNTVIVIAGDALCALMNGRIPSPYHRVRVTEKKKTRYAAALFSNPKEGYIIDSPKELVDEKHPRAFKPFDFVDLFNFYHTEAGRRAPSTLQAFCGVSAGK

SEQ ID NO: 266 - protein, 726 aa, Arabidopsis thaliana
MESLVAICDTFISSIDDSGVGHVDDCVAGYFSASASQTGTPDRVARLMSERLHHPKKWILRAGLWLLSTWIGSLVLCGWRSFTGEFPYFRRFCRLPEKRREEILLNWSSSYFSLLRMLFRTIKLISALVFFTQVDEKGRNLAWKAIGYNGPSPDHSDHEVELNEEKKKKKPEEIFGPLYNGIVDLKSPREAVEKKLAGRGFAVSNQKRNTNGSSISDPVMKIQCDAVVVGSGSGGGVAAGVLAKAGYKVLVIESGNYYARSKLSLLEGQAMDDMYLSGGLLATSDTNVVILAGSTVGGGSTINWSASIKTPEHVMKEWAEKSKLEMFGSDLYREAMDVVCKRMGVQCGFVEEGFNNEVLRKGCEKLGLPVKNIPRNAPSDHYCGFCCLGCKKGQKQGTSETWLVDLVESDNGLILPGCQATEVMYDCEQGKKKKATGVAFAFGEEIYVVESRVTIVACGALRTPHLLKRSGLKNSNIGRNLCLHPVVMAWGWFPEEDKWPEKKKKSYEGGIMTAMSSVVIEETHSSYGEMVIQTPALHPGMFSGIIPWTSSKDFKTRMLKFSRTAHIFALLRDKGTGTIDSKTYIDYNLNDEDEESLKNGLERVLKILAAAGAEEIGTHHSEGRSLNVRTASSLEIERFVREESSKPLKDLSGQICSAHQMGSCRMGIRPEESAVRPTGETWEVERLFVADTSVFPTALGVNPMVTVQSIAYCIGLNVVDVLKKKK

SEQ ID NO: 267 - protein, 391 aa, Arabidopsis thaliana
MALSLLSYNVSDLCLGKPPLRCLSSSSSSVSDAIAALKSSEDTFLSVWNCNHDDDNNTECECLGKISMADVICHLSKDHDHSLCALNSSVSVLLPKTRSIVLHVQPSCSLIEAIDLIIKGAQNLIVPIHTKPYTKKKQHNDNVSVTTTTHSNGQRFCWITQEDIIQFLLGFIAAFSPLPAMSLSDLGVINSTHTVVAVDYHSSASAVVSAVSNALAVQTSVAVVDGEGDDPFTSLIGEISPMTLTCCDETAAAAVATLSAGDLMAYIDGANPPESLVQIVRNRLEDKGLIGLMSLFDSLSSYSTSSGYSSEEEAPVRTTSYGRSMSSSARMARKSEAIVCNPKSSLMAVMIQAVAHRVNYAWVVEKDGCFVGMVTFVDILKVFRKFLENDM

SEQ ID NO: 268 - protein, 337 aa, Arabidopsis thaliana
MEENCEDCMKWEEELYWTHFQTLHFTQLLLPGFHNRLVIPRKFSTHCKRKLPQIVTLKSPSGVTYNVGVEEDDEKTMAFRFGWDKFVKDHSLEENDLLVFKFHGVSEFEVLVFDGQTLCEKPTSYFVRKCGHAEKTKASHTGYEQEEHINSDIDTASAQLPVISPTSTVRVSEGKYPLSGFKKMRRELSNDNLDQKADVEMISAGSNKKALSLAKRAISPDGFLVFMKRSHVVSKCFLTIPYKWCVKNMLITRQEVVMQVDQTKWEMKFNIFGARGSGGISTGWKKFVQDNNLREGDVCVFEPANSETKPLHLNVYIFRGEETERTNNVDPVYTISE

SEQ ID NO: 269 - protein, 453 aa, Arabidopsis thaliana
MTKRSVSRNLVTCLASPKFSLNVLCLVVTVFVLLQIWSFHITQQPILLPPSLFTYLKEQQQEPEQIKSENETAYLVEKLRESVTFLPLKDLRFSNKPLEGHTWFMSSLYDNQTKGEVQYQEFPSESSKGRLLCLKGVDEHDGSYGTTYALAWPQALPVNASLQEGLTFVSYNHYDYGNMWHGLSAMVPFVAWSLRHQCENPQRWVLYHWGELRFKMGNWLNEIITATYGQNTEFLRFRDKNRPGEKNGSLDLIRCKARHYCNISLSETSKSRIGMTLLMRTGPRSFKNESAVIDIFKRECKNVEGCELKVSYSNNLTFCEQVELMRMTDVLVSPHGAQLTNLVLMDRNSSVMEFLPKGWRKLAGVGQLVYQWGTRWSGMRHEGSWHDPDGEICQFPDTDRRCMSSVYKNGRIGYNETYFGEWAKSVLGKFKERKMANVVGRKHSYGSLDGCWC

SEQ ID NO: 270 - protein, 541 aa, Arabidopsis thaliana
MYHHLQTRIFLHQQNDLLRAENRARIHAMTSPSICRSCEEPIISTEERELWLENARLRSEIDTLTCFIWRLNSFRNLYPAFATSLTEVGYGVAVMTSLSLKEVVFLARQRTPMWTSNGRLNLDEYYSKLFPWYARNAPGFVHEVSRASAFVPCDASSLVANLMNHVSWQKIFPSIIADVSVESQQRGLQKINVNFMPQISPLIQTRNVKLLRRSRHIEDDTWAIAEISMYFSSYAQHLRPEYMRFPSGYLIQHIANGISKVTILDHWVYKEEEGMNTFNSNSEFGAQRWLTALQKHYYNTCPVSIPSIGHNIQIFDQICRKNLLNLSSFMVNVFCSGVCGITGQRWNRLNTVGVSANNIRMFTQESRGMSGIPCVLVSATGLARMHTKPEVMFGLINGAEKQEIWSYLESAKDMKELIRIGRHPNSWNEVSVFSIEWKGSKEWYLIQETYYDESGAMIIHTCVEAPYFAAAINGGDLSGVELLPSGFTIIPCESQECFVTASCYVKADQTMVTSPNELGSYMENMVTNILGNVQNALPVHR

SEQ ID NO: 271 - protein, 385 aa, Arabidopsis thaliana
MHDSEIFKFKDMMMMSCTVQTLVLVPWFLVVFVLAGGEDSSETTAMFPAMFVFGDSLVDNGNNNHLNSLARSNYLPYGIDFAGNQPTGRFSNGKTIVDFIGELLGLPEIPAFMDTVDGGVDILHGVNYASAAGGILEETGRHLGERFSMGRQVENFEKTLMEISRSMRKESVKEYMAKSLVVVSLGNNDYINNYLKPRLFLSSSIYDPTSFADLLLSNFTTHLLELYGKGFRKFVIAGVGPLGCIPDQLAAQAALPGECVEAVNEMAELFNNRLVSLVDRLNSDNKTASEAIFVYGNTYGAAVDILTNPFNYGFEVTDRGCCGVGRNRGEITCLPLAVPCAFRDRHVFWDAFHPTQAFNLIIALRAFNGSKSDCYPINLSQLSRL

SEQ ID NO: 272 - protein, 175 aa, Arabidopsis thaliana
MGLVTKALKYLLLLSISLTFIYTNAVSSASPMTPPSSPAKMSRRLVAVEGMVYCKSCKYSGVDTLLEASPLQGATVKLACNNTKRGVTMETKTDKNGYFFMLAPKKLTTYAFHTCRAWPTNPGPTTATMTCTVPSKLNNGITGAMLKPSKTINIGEHDYVLFSVGPFAFEPACAL

SEQ ID NO: 273 - protein, 508 aa, Arabidopsis thaliana
MCKMEKFLYHRKLWEMNVKLLGESKVEKLKNSFVSRPRMSLWMIRAVTVLLLWSCFVHLMALGEMWGPRLFKGWPSCFNHHQLSTAAEMTSLPTKIALPPKRVYVNNGYLMVSCNGGLNQMRAAICDMVTVARYMNVTLIVPELDKTSFWNDPSEFKDIFDVDHFISSLRDEVRILKELPPRLKKRVELGVYHEMPPISWSNMSYYQNQILPLVKKHKVLHLNRTDTRLANNGLPVEVQKLRCRVNFNGLKFTPQIEELGRRVVKILREKGPFLVLHLRYEMDMLAFSGCSHGCNPEEEEELTRMRYAYPWWKEKVINSELKRKDGLCPLTPEETALTLTALGIDRNVQIYIAAGEIYGGQRRMKALTDAFPNVVRKETLLESSDLDFCRNHSSQMAALDYLVALESDIFVPTNDGNMARVVEGHRRFLGFKKTIQLNRRFLVKLIDEYTEGLLSWDVFSSTVKAFHSTRMGSPKRRLVIPNRPKEEDYFYANPQECLQLLDEPLRVI

SEQ ID NO: 274 - protein, 401 aa, Arabidopsis thaliana
MSMALLLTSPAMKQKPAVITSPRRGSSPSRRLRVSCVTTNPARKKNETCNHFRPIKEVNNQLTHTIPQEKLEIFKSMENWAEQKLLPYLKPVEDSWQPQDFLPAPENDDEFYDRVKEIRERTKEIPDDYFVVLVGDMITEEALPTYQTTLNTLDGVKDETGGSLSPWAVWIRAWTAEENRHGDLLNKYLYLTGRVDMRHVEKTIQYLIGSGMDSKFENNPYNGFIYTSFQERATFISHGNTARLATTYGDVTLAKICGTIAADEKRHETAYTKIVEKLFEIDPDGSVQALASMMKKRITMPAHLMHDGRDNDLFDHYAAVAQRIGVYTAADYAGILEFLLRRWKVESLGLGLSGEGRRAQEYLCTLPQRIKRLEERANDRVKLVSKPSVSFSWVFGRDVKL

SEQ ID NO: 275 - protein, 243 aa, Arabidopsis thaliana
MSAVKSALGDMVITFLWVILSATFGIQTAAIVSAVGFHGITWAPLVISTLVVFVSISIFTVIGNVLGGASFNPCGNAAFYTAGVSSDSLFSLAIRSPAQAIGAAGGAITIMEMIPEKYKTRIGGKPSLQFGAHNGAISEVVLSFSVTFLVLLIILRGPRKLLAKTFLLALATVSVFVVGSKFTRPFMNPAIAFGWAYIYKSHNTWDHFYVYWISSYTGAILSAMLFRIIFPAPPLVQKKQKKA

SEQ ID NO: 276 - protein, 280 aa, Arabidopsis thaliana
MLPRNATDKIQGNVSKPCFWKSLSPGQNWKSKSMRSFPEEFVKSTPGAFEHRVVFSVRWGNSWQLWLEREEKDLFMIEEDWDEFVDDNHLGPNDNVFFRHDDKMFLEVQIFKNDGNEIIDAPPEVEPETEPFHPTTPKNSHKETTTASASASASEFSDNWRETHGCADIKNPELYLLNPKNPYFVKTLTKGNDVLYVPKTVIKKYGLKFGPHLSPMHYLLPGDKINGSTKIYGGGSAPCFNGWVDLCRKYNLKTGDSMVCELERSGELVTAVRVHFINKT

SEQ ID NO: 277 - protein, 222 aa, Arabidopsis thaliana
MRVSQSLIPFAIIALVLSFVNAYDPSPLQDFCVAIDDLKGVFVNGRFCKDPERVDAKDFFFSGLNVPGNTNNQVGSNVTTVNVDQIPGLNTMGISLVRIDYAPHGQNPPHTHPRGSEILVLVEGTLYVGFVSSNQDNNRLFAKVLHPGDVFVFPIGMIHFQLNIGKIPAIAFAGLSSQNAGVITIANTVFGSNPPIYPELLARAFQLDANVVKELQAKFGSI

SEQ ID NO: 278 - protein, 222 aa, Arabidopsis thaliana
MRVSQSLVPFAIIALVLSFVNAYDPSPLQDFCVAIDDLKGVFVNGRFCKDPKRVDAKDFFFSGLNMPGNTNNQVGSNVTTVNVDQIPGLNTMGISLVRIDYAPHGQNPPHTHPRGSEILVLVEGTLYVGFVSSNQDNNRLFAKVLHPGDVFVFPIGMIHFQVNVGKIPAVAFAGLSSQNAGVITIANTVFGSNPPIYPELLARAFQLDASVVKELQAKFGSI

SEQ ID NO: 279 - protein, 200 aa, Arabidopsis thaliana
MRVSQSLVPFAIIALVLSFVNAYDPSPLQDFCVAIDDLKGGLNMPGNTNNQVGSNVTTVNVDQIPGLNTMGISLVRIDYAPHGQNPPHTHPRGSEILVLVEGTLYVGFVSSNQDNNRLFAKVLHPGDVFVFPIGMIHFQVNVGKIPAVAFAGLSSQNAGVITIANTVFGSNPPIYPELLARAFQLDASVVKELQAKFGSI

SEQ ID NO: 280 - protein, 222 aa, Arabidopsis thaliana
MRVSQSLVPFAIIALVLSFVNAYDPSPLQDFCVAIDDLKGVFVNGRFCKDPKRVDAKDFFFSGLNVPGNTNNQVGSNVTTVNVDQIPGLNTMGISLVRIDYAPHGQNPPHTHPRGSEILVLVEGTLYVGFVSSNQDNNRLFAKVLHPGDVFVFPIGMIHFQVNVGKIPAVAFAGLSSQNAGVITIANTVFGSNPPIYPELLARAFQLDASVVKELQAKFGSI

SEQ ID NO: 281 - protein, 532 aa, Arabidopsis thaliana
MRTLEAFALSLFLVFLVKWVNSDSSSSPSKDQFLSCMSTHSDSSFINPKSFIHKPDSRVYTDFSQSLISQNYRFLTLNFTSQKPILIVTPRTDTEIQRSLLCSRKLGVKVRTKSGGHDYEGLSYLSLHSPFIILDLVNVRSIEINLADETAWVGAGATIGELYYKIAKSSKIHGFPAGTCPSVGVGGHFSGGGFGAMMRKHGLAADNVVDARFVDANGRIYNSRREMGEDLFWAIRGGGAASFGVVLSWKVKLVRVPEKVTCFRRNLPLTQNMTKIVHRWQQIAAELDDNLFIRVIVSISGGSVQTTFQANYLGGIDKLIPLMNQKFPELGLTFQDCSEMTWIDSIMYFNWKKGQPLETLLDRGQRYNDLYFKAKSDFVKNPIPEIGLEGIWTRFHEVESPIMIMEPLGGKMYEIGETETPFPHRRGNLYNIQYMVKWRLKDIGVMEKHVTWMRLLYRYMRVYVSASPRGAYLNYRDLDLGMNRGVNTSFEDAKLWGFRYFGSNFKRLAIVKGKIDPTNFFRNEQSVPPLIV

SEQ ID NO: 282 - protein, 234 aa, Arabidopsis thaliana
MERGGFHGYRKLSVNNTTPSPPGLAANFLMAEGSMRPPEFNQPNKTSNGGEEECTVREQDRFMPIANVIRIMRRILPAHAKISDDSKETIQECVSEYISFITGEANERCQREQRKTITAEDVLWAMSKLGFDDYIEPLTLYLHRYRELEGERGVSCSAGSVSMTNGLVVKRPNGTMTEYGAYGPVPGIHMAQYHYRHQNGFVFSGNEPNSKMSGSSSGASGARVEVFPTQQHKY

SEQ ID NO: 283 - protein, 497 aa, Arabidopsis thaliana
MPSVKLTHHSPPDTIASDSVRLLSRETLRISASLASPPVDDLPPHSPPPPDSQFLHSTLRLICCEEIDGRRFKYVAESDGSGRFKKNSVRAISLESPQTPFDEVGSFLRSYVVPEGFPGSVNESYVPYMTWRALKHFFGGAMGVFTTQTLLNSVGASRNSSASAAVAINWILKDGAGRVGKMLFARQGKKFDYDLKQLRFAGDLLMELGAGVELATAAVPHLFLPLACAANVVKNVAAVTSTSTRTPIYKAFAKGENIGDVTAKGECVGNIADLMGTGFSILISKRNPSLVTTFGLLSCGYLMSSYQEVRSVVLHTLNRARFTVAVESFLKTGRVPSLQEGNIQEKIFTFPWVDDRPVMLGARFKDAFQDPSTYMAVKPFFDKERYMVTYSPTKGKVYALLKHQANSDDILKAAFHAHVLLHFMNQSKDGNPRSVEQLDPAFAPTEYELESRIAESCEMVSTSYGVFKSRAAEQGWRMSESLLNPGRARLCHVKEGE

SEQ ID NO: 284 - protein, 387 aa, Arabidopsis thaliana
MESPSLPMTAKDWTTTSLHRVFAMQGGEDDLSYVNNSDSQALAITLSKPILISSLQSIKLFSDQTPIKITDLGCATGSNTFTTVDTVVETLQRRYTARCGGGGSPEFEAFFCDLPSNDFNMLFKLLAEKQKVDSPAKYFAGGVAGSFYDRLFPRGTIHVAVSLSALHWLSQIPEKVLEKESRTWNKGKTWIEGAKKEVVEAYAEQSDKDLDDFMSCRKEEMVKGGVLFVLMAGRPSGSSSQFGDQDTRAKHPFTTTMEQAWQDLIEEGLIDEETRDGFNIPAYMRSPEEVTAGIDRCGGFKIGKMDFLKIVEYSDEKQEEWKKDPVSYGRARTNLVQAAIRPMVDAYLGPDLSHELFKRYENRVSTNQEFLHITCFYGVVVFSAIRV

SEQ ID NO: 285 - protein, 288 aa, Arabidopsis thaliana
MKSCLATFALAVLVTQGSIFSLCLASSASTNSVPNWFHHWPPFKWGPKFPYSPPKPPPIEKYPPPVQYPPPIKKYPPPPYEHPPVKYPPPIKTYPHPPVKYPPPEQYPPPIKKYPPPEQYPPPIKKYPPPEQYSPPFKKYPPPEQYPPPIKKYPPPEHYPPPIKKYPPQEQYPPPIKKYPPPEKYPPPIKKYPPPEQYPPPIKKYPPPIKKYPPPEEYPPPIKTYPHPPVKYPPPPYKTYPHPPIKTYPPPKECPPPPEHYPWPPKKKYPPPVEYPSPPYKKYPPADP

SEQ ID NO: 286 - protein, 390 aa, Arabidopsis thaliana
MASSLEKLISSFLLVLYSTTIIVASSESRCRRFKSIISFGDSIADTGNYLHLSDVNHLPQSAFLPYGESFFHPPSGRYSDGRLIIDFIAEFLGLPYVPSYFGSQNVSFDQGINFAVYGATALDRVFLVGKGIESDFTNVSLSVQLNIFKQILPNLCTSSSRDCREMLGDSLILMGEIGVNDYNYPFFEGKSINEIKQLVPLVIKAISSAIVDLIDLGGKTFLVPGNFPLGCYPAYLTLFQTAAEEDHDPFTGCIPRLNEFGEYHNEQLKTELKRLQELYDHVNIIYADYYNSLFRLYQEPVKYGFKNRPLAACCGVGGQYNFTIGKECGHRGVSCCQNPSEYVNWDGYHLTEATHQKMAQVILNGTYASPAFDWSCSGSESVDKEYSFSS

SEQ ID NO: 287 - protein, 152 aa, Arabidopsis thaliana
MGALNYLSEYFSNHFYVSIRKRKKRKVMQTVNIKVKIDCDGCERKIKNAVSSIKGAKSVEVNRKMHKVTVSGYVDPKKVLKTVQSTGKKKAELWPYVPYTMVAYPYAAGAYDKRAPPGFVRKSEQAQAQPGSTDDKLMSLFSDENPNACTVM

SEQ ID NO: 288 - protein, 824 aa, Arabidopsis thaliana
MLLSALGVGVGVGVGLGLASGQAVGKWAGGNSSSNNAVTADKMEKEILRQVVDGRESKITFDEFPYYLSEQTRVLLTSAAYVHLKHFDASKYTRNLSPASRAILLSGPAELYQQMLAKALAHFFDAKLLLLDVNDFALKIQSKYGSGNTESSSFKRSPSESALEQLSGLFSSFSILPQREESKAGGTLRRQSSGVDIKSSSMEGSSNPPKLRRNSSAAANISNLASSSNQVSAPLKRSSSWSFDEKLLVQSLYKVLAYVSKANPIVLYLRDVENFLFRSQRTYNLFQKLLQKLSGPVLILGSRIVDLSSEDAQEIDEKLSAVFPYNIDIRPPEDETHLVSWKSQLERDMNMIQTQDNRNHIMEVLSENDLICDDLESISFEDTKVLSNYIEEIVVSALSYHLMNNKDPEYRNGKLVISSISLSHGFSLFREGKAGGREKLKQKTKEESSKEVKAESIKPETKTESVTTVSSKEEPEKEAKAEKVTPKAPEVAPDNEFEKRIRPEVIPAEEINVTFKDIGALDEIKESLQELVMLPLRRPDLFTGGLLKPCRGILLFGPPGTGKTMLAKAIAKEAGASFINVSMSTITSKWFGEDEKNVRALFTLASKVSPTIIFVDEVDSMLGQRTRVGEHEAMRKIKNEFMSHWDGLMTKPGERILVLAATNRPFDLDEAIIRRFERRIMVGLPAVENREKILRTLLAKEKVDENLDYKELAMMTEGYTGSDLKNLCTTAAYRPVRELIQQERIKDTEKKKQREPTKAGEEDEGKEERVITLRPLNRQDFKEAKNQVAASFAAEGAGMGELKQWNELYGEGGSRKKEQLTYFL

SEQ ID NO: 289 - protein, 829 aa, Arabidopsis thaliana
MDSKQMLLSALGVGVGVGVGLGLASGQAVGKWAGGNSSSNNAVTADKMEKEILRQVVDGRESKITFDEFPYYLSEQTRVLLTSAAYVHLKHFDASKYTRNLSPASRAILLSGPAELYQQMLAKALAHFFDAKLLLLDVNDFALKIQSKYGSGNTESSSFKRSPSESALEQLSGLFSSFSILPQREESKAGGTLRRQSSGVDIKSSSMEGSSNPPKLRRNSSAAANISNLASSSNQVSAPLKRSSSWSFDEKLLVQSLYKVLAYVSKANPIVLYLRDVENFLFRSQRTYNLFQKLLQKLSGPVLILGSRIVDLSSEDAQEIDEKLSAVFPYNIDIRPPEDETHLVSWKSQLERDMNMIQTQDNRNHIMEVLSENDLICDDLESISFEDTKVLSNYIEEIVVSALSYHLMNNKDPEYRNGKLVISSISLSHGFSLFREGKAGGREKLKQKTKEESSKEVKAESIKPETKTESVTTVSSKEEPEKEAKAEKVTPKAPEVAPDNEFEKRIRPEVIPAEEINVTFKDIGALDEIKESLQELVMLPLRRPDLFTGGLLKPCRGILLFGPPGTGKTMLAKAIAKEAGASFINVSMSTITSKWFGEDEKNVRALFTLASKVSPTIIFVDEVDSMLGQRTRVGEHEAMRKIKNEFMSHWDGLMTKPGERILVLAATNRPFDLDEAIIRRFERRIMVGLPAVENREKILRTLLAKEKVDENLDYKELAMMTEGYTGSDLKNLCTTAAYRPVRELIQQERIKDTEKKKQREPTKAGEEDEGKEERVITLRPLNRQDFKEAKNQVAASFAAEGAGMGELKQWNELYGEGGSRKKEQLTYFL

SEQ ID NO: 290 - protein, 345 aa, Arabidopsis thaliana
MVVKNSIKFNSQSERKSLEETKVPPIFGLPPDALDDKKPTSDFAVPIIDFAGVHKSREAVVEKIKAAAENWGIFQVINHGVPLSVLEEIQNGVVRFHEEDPEVKKSYFSLDLTKTFIYHNNFELYSSSAGNWRDSFVCYMDPDPSNPEDLPVACRDAMIGYSKHVMSLGGLLFELLSEALGLNSDTLKSMGCMKGLHMICHYYPPCPQPDQTLGTSKHSDNTFITILLQDNIGGLQILHQDCWVDVSPLPGALIINIGDFLQLMTNDKFISVDHRVLTNRVGPRISIACFFSSSMNPNSTVYGPIKELLSEENPPKYRDFTIPEYSKGYIEKGLDGTSHLSHYRI

SEQ ID NO: 291 - protein, 280 aa, Arabidopsis thaliana
MGRPPCCDKIGIKKGPWTPEEDIILVSYIQEHGPGNWRSVPTNTGLLRCSKSCRLRWTNYLRPGIKRGNFTPHEEGMIIHLQALLGNKWASIASYLPQRTDNDIKNYWNTHLKKKLNKSDSDERSRSENIALQTSSTRNTINHRSTYASSTENISRLLEGWMRASPKSSTSTTFLEHKMQNRTNNFIDHHSDQFPYEQLQGSWEEGHSKGINGDDDQGIKNSENNNGDDVHHEDGDHEDDDDHNATPPLTFIEKWLLEETSTTGGQMEEMSHLMELSNML

SEQ ID NO: 292 - protein, 197 aa, Arabidopsis thaliana
MVVVRWASIASYLPQRTDNDIKNYWNTHLKKKLNKSDSDERSRSENIALQTSSTRNTINHRSTYASSTENISRLLEGWMRASPKSSTSTTFLEHKMQNRTNNFIDHHSDQFPYEQLQGSWEEGHSKGINGDDDQGIKNSENNNGDDVHHEDGDHEDDDDHNATPPLTFIEKWLLEETSTTGGQMEEMSHLMELSNML

SEQ ID NO: 293 - protein, 326 aa, Arabidopsis thaliana
MDETKIPKKLQSDDEENISLISSLPFDVDFDSTKLFKYQGCWYDDKTLQGVLNFQRGFEPQDTDIIIASFPKSGTTWLKALTVALLERSKQKHSSDDHPLLLDNPHGLVPFLELRLFTETSKPDLTSISSSPRLFSTHVAFQTLREALKNSPCKIVYVWRNVKDVLVSFWYFNSAKLKIEEERSILDSMFESFCRGVINYGPSWEHVLNYWRASLEDSKNVLFLKYEELKTEPRVQLKRLAEFLDCPFTVEEEERGSVEEILDLCSLRNLKNLEINKTGKTLRGADHKIFFRKGEVGDSKNHLTPEMEKIIDMITEEKFEGSDLKF

SEQ ID NO: 294 - protein, 385 aa, Arabidopsis thaliana
MTTTLLMASLIVSFLLILYYTTIVVASSESRCRRYKSIISFGDSIADTGNYVHLSNVNNLPQAAFLPYGESFFHPPSGRYSDGRLVIDFIAEFLGLPYVPPYFGSQNVSFNQGINFAVYGATALDRAFLVKQGIKSDFTNISLSVQLNTFKQILPNLCASSTRDCREMLGDSLILMGEIGGNDYNYPFFEGKSINEIKELVPLIIKAISSAIVDLIDLGGKTFLVPGNFPIGCSTAYLTLFQTATVEHDPFTGCIPWLNKFGEHHNEQLKIELKQLQKLYPHVNIIYADYYNSLYGLFQEPAKYGFKNRPLAACCGVGGQYNFTIGKECGENGVSYCQNPSEYVNWDGYHLTEATYQKMAQGLLNGRYTTPAFDWSCLGSYDFSG

SEQ ID NO: 295 - protein, 206 aa, Arabidopsis thaliana
MASSPRWTEDDNRRFKSALSQFPPDNKRLVNVAQHLPKPLEEVKYYYEKLVNDVYLPKPLENVTQHLQKPMEMEEMKYMYEKMANDVNQMPEYVPLAESSQSKRRKKDTPNPWTEEEHRLFLQGLKKYGEGASTLTSTNFVKTKTPRQVSSHAQYYKRQKSDNKKEKRRSIFDITLESTEGNPDSGNQNPPDDDDPSQGQGTCLGV

SEQ ID NO: 296 - protein, 480 aa, Arabidopsis thaliana
MEISERARARLAVLNAHLTVSEPNQVLPAIEPWCTSAHITAAPHGSLKGNLKIVDERTGNEYQVPVSEHGTVKTVDLKKITTGKDDKGLNLYDPGYLNTAPVRSSISYIDGDEGILRYRGYPVEELAEKSTYTEVTYLLIYGNLPSQRQLADWEFAISQNSAVPQGVLDMIQSMPNDVHPVGALVTAMSALSIFYPDANPSLMGLGVYKSKQVRDKQIVRVLGQAPTIAAAAYLRKAGKPPVQPLSNLSYSENFLYMVESMGDRSYKPNPRLARVLDILFILQAEHEMNCSTAAARHLSSSGGDVYTAVSGGVGAIYGPLHGGAVEATINMLSEIGTVENIPEFIESVKNKKRRLSGFGHRIYKNYDPRGKVVKKLADEVFSILGRDPLVEVGDALEKAALSDEYFVKRKLYPNVDFYSGLINRAMGIPSSFTAVSRIAGYLSHWRESLDDPDTKIMRPQQVYTGAGIRHYETVRERTKL

SEQ ID NO: 297 - protein, 154 aa, Arabidopsis thaliana
MSLDANTCSIVFFLFFTVSFAVSGQKPTAYDAVKLYNLPPGILPKGVVDYELNPKTGNFKVYFNDTCEFTIQSYQLKYKSTISGVISPGHVKNLKGVSVKVLFFWVNIAEVSLDGADLDFSVGIASASFPAANFEESPQCGCGFDCNNGLLFSS

SEQ ID NO: 298 - protein, 522 aa, Arabidopsis thaliana
MTRFAVLPLSVLLLVLLFLCTESLAKSEESEEYDVAVPSCCGFSSPLLIKKDQWKPIFETKFGQISTVQIGNGCGGMGPYKIHSITLEPNTILLPLLLHSDMVFFVDSGSGILNWVDEEAKSTEIRLGDVYRLRPGSVFYLQSKPVDIFLGTKLKLYAIFSNNDECLHDPCFGAYSSITDLMFGFDETILQSAFGVPEGIIELMRNRTKPPLIVSETLCTPGVANTWQLQPRLLKLFAGSADLVDNKKKKEKKEKKEKVKKAKTFNVFESEPDFESPYGRTITINRKDLKVLKGSMVGVSMVNLTQGSMMGPHWNPWACEISIVLKGAGMVRVLRSSISSNTSSECKNVRFKVEEGDIFAVPRLHPMAQMSFNNDSLVFVGFTTSAKNNEPQFLAGEDSALRMLDRQVLAASLNVSSVTIDGLLGAQKEAVILECHSCAEGEIEKLKVEIERKKIDDERKRRHDERKKEEEEAKREEEERRKREEEEEKKRWPPQQPPQEEELRERQLPMEKEWEMEGEEES

SEQ ID NO: 299 - protein, 380 aa, Arabidopsis thaliana
MATECIATVPQIFSENKTKEDSSIFDAKLLNQHSHHIPQQFVWPDHEKPSTDVQPLQVPLIDLAGFLSGDSCLASEATRLVSKAATKHGFFLITNHGVDESLLSRAYLHMDSFFKAPACEKQKAQRKWGESSGYASSFVGRFSSKLPWKETLSFKFSPEEKIHSQTVKDFVSKKMGDGYEDFGKVYQEYAEAMNTLSLKIMELLGMSLGVERRYFKEFFEDSDSIFRLNYYPQCKQPELALGTGPHCDPTSLTILHQDQVGGLQVFVDNKWQSIPPNPHAFVVNIGDTFMALTNGRYKSCLHRAVVNSERERKTFAFFLCPKGEKVVKPPEELVNGVKSGERKYPDFTWSMFLEFTQKHYRADMNTLDEFSIWLKNRRSF

SEQ ID NO: 300 - protein, 337 aa, Arabidopsis thaliana
MVVMKAQPLVPAIFIFGDSVVDVGNNNDIYTIVKANFPPYGRDFTTHTPTGRFCNGKLATDFTAENLGFKSYPQAYLSKKAKGKNLLIGANFASAASGYYDGTAKLYSAISLPQQLEHYKDYISRIQEIATSNNNSNASAIISNGIYIVSAGSSDFIQNYYINPLLYRDQSPDEFSDLLILSYSSFIQNLYSLGARRIGVTTLPPLGCLPAAITVVGPHEGGCSEKLNNDAISFNNKLNTTSQDLKRNLIGLNLVVFDIYQPLYDLATRPSEFGFAEARRACCGTGLLETSILCNPKSVGTCNNATEYVFWDGFHPTEAANKILADNLLVSGISLIS

SEQ ID NO: 301 - protein, 318 aa, Arabidopsis thaliana
MSSSSSRNAFEDGKYKSNLLTLDSSSRCCKITPSSRASPSPPKQLLVATPVEEGDYPVVMLLHGYLLYNSFYSQLMLHVSSHGFILIAPQLYSIAGPDTMDEIKSTAEIMDWLSVGLNHFLPAQVTPNLSKFALSGHSRGGKTAFAVALKKFGYSSNLKISTLIGIDPVDGTGKGKQTPPPVLAYLPNSFDLDKTPILVIGSGLGETARNPLFPPCAPPGVNHREFFRECQGPAWHFVAKDYGHLDMLDDDTKGIRGKSSYCLCKNGEERRPMRRFVGGLVVSFLKAYLEGDDRELVKIKDGCHEDVPVEIQEFEVIM

SEQ ID NO: 302 - protein, 558 aa, Arabidopsis thaliana
MKNNNNKSSSSSSYDSSLSPSSSSSSHQNWLSFSLSNNNNNFNSSSNPNLTSSTSDHHHPHPSHLSLFQAFSTSPVERQDGSPGVSPSDATAVLSVYPGGPKLENFLGGGASTTTTRPMQQVQSLGGVVFSSDLQPPLHPPSAAEIYDSELKSIAASFLGNYSGGHSSEVSSVHKQQPNPLAVSEASPTPKKNVESFGQRTSIYRGVTRHRWTGRYEAHLWDNSCRREGQSRKGRQVYLGGYDKEDKAARAYDLAALKYWGPTTTTNFPISNYESELEEMKHMTRQEFVASLRRKSSGFSRGASMYRGVTRHHQHGRWQARIGRVAGNKDLYLGTFSTQEEAAEAYDIAAIKFRGLNAVTNFDISRYDVKSIASCNLPVGGLMPKPSPATAAADKTVDLSPSDSPSLTTPSLTFNVATPVNDHGGTFYHTGIPIKPDPADHYWSNIFGFQANPKAEMRPLANFGSDLHNPSPGYAIMPVMQEGENNFGGSFVGSDGYNNHSAASNPVSAIPLSSTTTMSNGNEGYGGNINWINNNISSSYQTAKSNLSVLHTPVFGLE

SEQ ID NO: 303 - protein, 348 aa, Arabidopsis thaliana
MEDSNSHPQNQTSKRKSSHPQKKQRMENETRSAKLLDLDVLDCPVCFEPLTIPTFQCDDGHIVCNFCFAKVSNKCPGPGCDLPIGNKRCFAMERVLESAFVPCQNTEFGCTKSVSYEKVSSHEKECNYSQCSCPNLECNYTGSYNIIYGHFMRRHLYNSTIVSSKWGYSTVDVLINIKEKVSVLWESRQKLLFVVQCFKERHGVYVTVRRIAPPASEFKKFSYRLSYSIDGHNVTYESPEVKRLLEVNSQIPDDSFMFVPNCLLHGEMLELKLGIKKLKQTCIIQKLSGLVPGSVLYIVGFLIKPANEVQQVTIAQETVMEDPPTSLFKNSVPIREDQIQNAITNSIR

SEQ ID NO: 304 - protein, 363 aa, Arabidopsis thaliana
MGLFLVLFPDHNNNDSSSYYSPAKTTFRSKLSSRLLLSKAESTISSCIILLFLTLFLFTLSTFEEPSSRFPAISSPHWRFLLNRNIISRRFALQGMGTLFLRGTKSMHDLIIAHIASVTTENDLRLFIRLLHRSGVTSKSDVVLLFNSPSSTTRFTELIEQENNSFLKLVHVHRNDSMTSSSSSSEHVIWGKKSRHRANYNSNELTHGSIVGFDVTELDPENSLSGFMDQVPLSLRRWACYPMLLGRVRRSFKHVMLVDAKTSFFIGDPFTRIRNRSPDSVLFFFSKHKNASEVNPEILIGGAKGIRRLSSSMHTEIVRATMMKKNSVTEVTESVVLSQLVGNVHMTKNFQVVLSESVVPEAN

SEQ ID NO: 305 - protein, 248 aa, Arabidopsis thaliana
MKREYLDYTLVPLGLALMVFYHLWLLYRIIHRPSSTVVGLNAFNRRLWVQAMMEDSSKNGVLAVQTLRNNIMASTLLASTAIMLCSLIAVLMTSATGERSVWFVFGDKSDRAFSLKFFAILVCFLVAFLLNVQSIRYYSHASILINVPFKQLMAVSSGGRGNGSLMINQDYVAATVNRGSYFWSLGLRAFYFSSPLFLWIFGPIPMFITCCVLVCSLYFLDLTFDSMKCSVGAADAEEPEIRSLAQNV

SEQ ID NO: 306 - protein, 265 aa, Arabidopsis thaliana
MENKNQKRFVLIHGVCHGAWTWDKVKTQLEVAGHCVTAVDLAASGINMTKVEEIQTLNDYCKPLLEFLSSLGSDDGKVIVVAHSMGGISAALAADSFACKIAAIVFLTAFMPDTINPPAYVYEKLLRSIPQEEWLDTTCVNYGKPDFPLQYTLLGPKFMAKKMYQNSPVQDLEVVKTLVRENPLVTNNLAGTRSFSEEGYGSVTRIYIVCREDLVEVEDYQRWMISNFPPKEVMEIKCADHMPMFSKPQEVCALLLEIANKYCKN

SEQ ID NO: 307 - protein, 236 aa, Arabidopsis thaliana
MENKNQKRFVLIHGVCHGAWTWDKVKTQLEVAGHCVTAVDLAASDDGKVIVVAHSMGGISAALAADSFACKIAAIVFLTAFMPDTINPPAYVYEKLLRSIPQEEWLDTTCVNYGKPDFPLQYTLLGPKFMAKKMYQNSPVQDLEVVKTLVRENPLVTNNLAGTRSFSEEGYGSVTRIYIVCREDLVEVEDYQRWMISNFPPKEVMEIKCADHMPMFSKPQEVCALLLEIANKYCKN

SEQ ID NO: 308 - protein, 580 aa, Arabidopsis thaliana
MQKILCKSTTSSTPVLSTPVNSLAAGFISLGFKTPVKNLPPCSTTKPLSTCFFSTSAMPTTTASVSSGGVGFSAYLQRTVHKPAPASVRFSTAGYRTCRCSIDGTNRAWVGRTGSWRALFCSDSTGGLTPVNATAGAVVESEEESDGEDEDEEKDEKPVRMNRRNRSSSGSGEFVGNPDLLKIPGVGLRNQRKLVDNGIGDVAELKKLYKDKFWKASQKMVDYLRSSVGIIHRNHAESITTFIKESVDDELKDSGPEPNLNVKKRLTFCVEGNISVGKSTFLQRIANETVELQDLVEIVPEPVDKWQDVGPDHFNILDAFYSEPQRYAYTFQNYVFVTRLMQEKESASGVKPLRLMERSVFSDRMVFVRAVHEAKWMNEMEISIYDSWFDPVVSSLPGLVPDGFIYLRASPDTCHKRMMLRKRAEEGGVSLKYLQDLHEKHESWLLPFESGNHGVLSVSRPSLHMDNSLHPDIKDRVFYLEGNHMHSSIQKVPALVLDCEPNIDFSRDIEAKTQYARQVAEFFEFVKKKQETSTEKSNSQSPVLLPHQNGGLWMGPAGNHVPGLDLPPLDLKSLLTRPSA

SEQ ID NO: 309 - protein, 272 aa, Arabidopsis thaliana
MKIQILCFTTLFLAIFTSQVTTAYKFKFDYFGNGTDPISFHGDAEYGPDTDGKSRSGAIALTRDNIPFSHGRAIFTTPITFKPNASALYPFKTSFTFSITPKTNPNQGHGLAFIVVPSNQNDAGSGLGYLSLLNRTNNGNPNNHLFAVEFDVFQDKSLGDMNDNHVGIDINSVDSVVSVKSGYWVMTRSGWLFKDLKLSSGDRYKAWIEYNNNYKVVSVTIGLAHLKKPNRPLIEAKFDLSKVIHEVMYTGFAGSMGRGVERHEIWDWTFQN

SEQ ID NO: 310 - protein, 330 aa, Arabidopsis thaliana
MASSLAQSRISNLQNHLSPLEANNKLRSLVKISPQVSEALSNGRAVVALESTIISHGMPYPQNLQTAKEVESIVRENGAIPATIAILNGVPCIGLSEEELERLASLGKSVQKTAGRDIANVVATRGNGATTVSATLFFASMVGIQVFVTGGIGGVHRHANHSMDISSDLTALGRTPIAVISAGVKSILDIPKTLEYLETQEVYVAAYKSDEFPAFFTEKSGCKAPSRVNSPEDCARVIDANMKLNRQAGILFAIPIPKHHSAAGNLIESATQRALTEAREQNVTGNAETPFLLARVNELTGGTSLAANIALVKNNALIGSQIAVALSQLM

SEQ ID NO: 311 - protein, 565 aa, Arabidopsis thaliana
MSHSFFNLFLISLFLYNNCIAHHYTFTVREVPYTKLCSTKAILTVNSQFPGPIIKVHKGDTIYVNVQNRASENITMHWHGVEQPRNPWSDGPEYITQCPIRPGSDFLYKVIFSIEDTTVWWHAHSSWTRATVHGLIFVYPRPPQILPFPKADHEVPIILGEWWKRDVREVVEEFVRTGGAPNVSDALTINGHPGFLYPCSKSDTFHLTVEKGKTYRIRMVNAAMNLPLFFAIANHSLTVVSADGHYIKPIKATYITISPGETLDMLLHADQDPERTYYMAARAYQSGNIDFNNSTTIGILSYTSSCKAKTSSFSGYYPTLPFYNDTSAAFGFFTKIKCLFSGQVPVQISRRIITTVSINLRMCPQNSCEGPNGSRLAASMNNISFVTPSHVDILKAYYYHIKGVYGTRFPEFPPLIFNFTAENQPLFLETPRLATEVKVIEFGQVVELVIQGTSLVGGGLDHPMHLHGFSFYVVGVGFGNYNISEEDPSSRYNLYDPPYKNTMTVPRNGWIAIRFVADNPGVWFMHCHLDRHQTWGMNVVFIVKNGREPNQQILPPPDDLPPCYE

SEQ ID NO: 312 - protein, 142 aa, Arabidopsis thaliana
MDVKKDENSILENMKQEINHSLKEEAQEEEEILKKRISSHPLYGLLLHSHLNCLKVCSGDFDSPEIMNTADDLALSKLSLHPDSSSEATSSELDQFMVLFFFSPCQNIFTQQKTTFHVLLFFPLQINLTFKYSKFILPRKKQ

SEQ ID NO: 313 - protein, 487 aa, Arabidopsis thaliana
MQDAERTTNDPVDRIEKVTWRDLQDGSFTAELKRLICFAAPMAAVVIIQFMIQIISMVMVGHLGRLSLASASFAVSFCNVTGFSFIIGLSCALDTLSGQAYGAKLYRKLGVQAYTAMFCLTLVCLPLSLLWFNMGKLIVILGQDPAIAHEAGRYAAWLIPGLFAYAVLQPLIRYFKNQSLITPLLVTSSVVFCIHVPLCWLLVYKSGLGHIGGALALSLSYWLYAIFLGSFMYYSSACSETRAPLTMEIFEGVREFIKYALPSAAMLCLEWWSYELIILLSGLLPNPQLETSVLSICFETLSITYSIPLAIAAAASTRISNELGAGNSRAAHIVVYAAMSLAVMDALMVSMSLLAGRHVFGHVFSSDKKTIEYVAKMAPLVSISIILDSLQGVLSGVASGCGWQHIGAYINFGAFYLWGIPIAASLAFWVHLKGVGLWIGILAGAVLQTLLLALVTGCTNWKTQAREARERMAVAHESELTESELPI

SEQ ID NO: 314 - protein, 412 aa, Arabidopsis thaliana
MAYPERSLIVDPRSGFCKSNSTFYSKRQPLSLPPNLSRDVTTFISSQPHRGKTAFIDAATGQCLTFSDLWRAVDRVADCLYHEVGIRRGDVVLILSPNSIFIPVVCLSVMSLGAVFTTANTLNTSGEISKQIADSNPTLVFTTRQLAPKLPVAISVVLTDDEVYQELTSAIRVVGILSEMVKKEPSGQRVRDRVNQDDTAMMLYSSGTTGPSKGVISSHRNLTAHVARFISDNLKRDDIFICTVPMFHTYGLLTFAMGTVALGSTVVILRRFQLHDMMDAVEKHRATALALAPPVLVAMINDADLIKAKYDLSSLKTVRCGGAPLSKEVTEGFLEKYPTVDILQGYALTESNGGGAFTNSAEESRRYGTAGTLTSDVEARIVDPNTGRFMGINQTGELWLKGPSISKGKITR

SEQ ID NO: 315 - protein, 199 aa, Arabidopsis thaliana
MEQSEEGQQQQQQGVMDYVPPHAYQSGPVNAASHMAFQQAHHFHHHHQQQQQQQLQMFWANQMQEIEHTTDFKNHTLPLARIKKIMKADEDVRMISAEAPVIFAKACEMFILELTLRAWIHTEENKRRTLQKNDIAAAISRTDVFDFLVDIIPRDELKEEGLGVTKGTIPSVVGSPPYYYLQQQGMMQHWPQEQHPDES

SEQ ID NO: 316 - protein, 121 aa, Arabidopsis thaliana
MNLAIKFHVMVLLLIVIGDVCANVGARPLEEVSKELMDKKAVSIPKTPLPLPPPLPTLPPAQLPGLPTPPKMSNGDTGGVDANADGRLPKDAPAGSHGATARGYRSGGGRSDASGSTDPWP

SEQ ID NO: 317 - protein, 233 aa, Arabidopsis thaliana
MRMSCNGCRVLRKGCSENCSIRPCLQWIKSAESQANATVFLAKFYGRAGLMNLLNTGPDHLRPAIFRSLLYEACGRIVNPIYGSVGLLWSGNWHLCQAAVEAVMRGSPVTPIACDAAVTGQAPPFNNKLCDIRHVSSRDENVKRRSRGACKEERNVRSLSHESSLSHESPVSSEETTTEEPKTWIGLELTLGLEPLARGNHVVVPMKKRKLERCGTSEDEDTCKIELGLVCSE

SEQ ID NO: 318 - protein, 691 aa, Arabidopsis thaliana
MELEGSSSGRRQLPSKLEMSRGAYLAWEDLTVVIPNFSDGPTRRLLQRLNGYAEPGRIMAIMGPSGSGKSTLLDSLAGRLARNVVMTGNLLLNGKKARLDYGLVAYVTQEDVLLGTLTVRETITYSAHLRLPSDMSKEEVSDIVEGTIMELGLQDCSDRVIGNWHARGVSGGERKRVSIALEILTRPQILFLDEPTSGLDSASAFFVIQALRNIARDGRTVISSVHQPSSEVFALFDDLFLLSSGESVYFGEAKSAVEFFAESGFPCPKKRNPSDHFLRCINSDFDTVTATLKGSQRIQETPATSDPLMNLATSVIKARLVENYKRSKYAKSAKSRIRELSNIEGLEMEIRKGSEATWWKQLRTLTARSFINMCRDVGYYWTRIISYIVVSISVGTIFYDVGYSYTSILARVSCGGFITGFMTFMSIGGFPSFLEEMKVFYKERLSGYYGVSVYILSNYISSFPFLVAISVITGTITYNLVKFRPGFSHYAFFCLNIFFSVSVIESLMMVVASVVPNFLMGLITGAGLIGIIMMTSGFFRLLPDLPKIFWRYPVSYISYGSWAIQGGYKNDFLGLEFEPLFPGEPKMTGEEVIEKVFGVKVTYSKWWDLAAVVAILVCYRLLFFVVLKLRERAGPALKAIQAKRTMRNLDRRPSFKRMPSLSLSLSSMSSRRHQPLRSLSSQEGLNSPIHY

SEQ ID NO: 319 - protein, 137 aa, Arabidopsis thaliana
MAMRFSSLTKIVLLSAAMLLLVHASARTLQQTQTLPLQGGGAAPTKDEPHMVNAPLEDQKNFIYGGGIGGVAGVGGFMGMPGGGSGGSGMTFPLPSGTPLLGGAGGLGGLGGAMGFPGGLGGGPSGGGVPSSSGGSP

SEQ ID NO: 320 - protein, 344 aa, Arabidopsis thaliana
MNTKTVKSMAGIVLSQISLVALFPLCICYQTHQSTSSVASLSPQFYENSCPNAQAIVQSYVANAYFNDPRMAASILRLHFHDCFVNGCDASVLLDSSGTMESEKRSNANRDSARGFEVIDEIKSALENECPETVSCADLLALVARDSIVICGGPSWEVYLGRRDAREASLIGSMENIPSPESTLQTILTMFNFQGLDLTDLVALLGSHTIGNSRCIGFRQRLYNHTGNNDPDQTLNQDYASMLQQGCPISGNDQNLFNLDYVTPTKFDNYYYKNLVNFRGLLSSDEILFTQSIETMEMVKYYAENEGAFFEQFAKSMVKMGNISPLTGTDGEIRRICRRVNHDV

SEQ ID NO: 321 - protein, 228 aa, Arabidopsis thaliana
MSSSGNPSSSSGGGGGPCGACKFLRRKCVAGCIFAPYFDSEQGAAHFAAVHKVFGASNVSKLLHHVPEHKRPDAVVSICFEAQARLRDPIYGCVSHIVSLQQQVVSLQTELSYLQAHLATLELPQPQPPQVPVSSSGSLQALSITDLPTISPSVYDLSSIFEPVMSSTWAMQQQPRPSDHLFGVPSSSNMGGGGELQALAREFIHGGQMPAQPSPGTSGSASSVIKRE

SEQ ID NO: 322 - protein, 236 aa, Arabidopsis thaliana
MSYSDPNQNPIPETYAPSNSTESEKLKLYQAFIFSVPICFTFIVLFVLYVIYLRRNSTTNVDWSSLGMRGGTFVPTNNNLSTAELGLSKDIREMLPVVIYKESFIVKDSQCSVCLGDYQAEEKLQQMPSCGHTFHMECIDLWLTSHTTCPLCRLSLIPKPSLDLSHQSTEIVSSIENSNGGEASTQPDSQSATEAISHTDDVEEGNRDSQEVSKETEENDRNSVGTSDGCCTCRLG

SEQ ID NO: 323 - protein, 213 aa, Arabidopsis thaliana
MTFPSLSVSFLFFAFIFVTHAFDLSIIQMQQGTCPYTVVVMTSCLSPESTRDQISIVFGDADGNKVYAPKLGGLVRGPGGLGKCSTNTFQVRGQCLNDPICSLYINRNGPDGWVPESIEIYSEGSKSVKFDFSKSVPQLNTWYGHNNCNTTGRPSSPDLPPPHFPPEFPPETPTTPPPPPPRPSAASRLGNGESVFLAFAIATAIAAMVRWSY

SEQ ID NO: 324 - protein, 185 aa, Arabidopsis thaliana
MQQGTCPYTVVVMTSCLSPESTRDQISIVFGDADGNKVYAPKLGGLVRGPGGLGKCSTNTFQVRGQCLNDPICSLYINRNGPDGWVPESIEIYSEGSKSVKFDFSKSVPQLNTWYGHNNCNTTGRPSSPDLPPPHFPPEFPPETPTTPPPPPPRPSAASRLGNGESVFLAFAIATAIAAMVRWSY

SEQ ID NO: 325 - protein, 318 aa, Arabidopsis thaliana
MASLKIPANIPLPEEDSEQLHKAFKGWGTNEGMIISILAHRNATQRSFIRAVYAANYNKDLLKELDGELSGDFERVVMLWTLDPTERDAYLANESTKLFTKNIWVLVEIACTRPSLEFFKTKQAYHVRYKTSLEEDVAYHTSGNIRKLLVPLVSTFRYDGNADEVNVKLARSEAKTLHKKITEKAYTDEDLIRILTTRSKAQINATLNHFKDKFGSSINKFLKEDSNDDYVQLLKTAIKCLTYPEKYFEKVLRRAINRMGTDEWALTRVVTTRAEVDLERIKEEYLRRNSVPLDRAIANDTSGDYKDMLLALLGHDHA

SEQ ID NO: 326 - protein, 626 aa, Arabidopsis thaliana
MGSSSYLLQTLGLLLLCCTVAANKVPLANAKYKDPKEPLGVRIKNLMSHMTLEEKIGQMVQVERVNATTEVMQKYFVGSVFSGGGSVPKPYIGPEAWVNMVNEVQKKALSTRLGIPIIYGIDAVHGHNTVYNATIFPHNVGLGVTRDPGLVKRIGEATALEVRATGIQYVFAPCIAVCRDPRWGRCYESYSEDHKIVQQMTEIIPGLQGDLPTGQKGVPFVAGKTKVAACAKHFVGDGGTLRGMNANNTVINSNGLLGIHMPAYHDAVNKGVATVMVSYSSINGLKMHANKKLITGFLKNKLKFRGIVISDYLGVDQINTPLGANYSHSVYAATTAGLDMFMGSSNLTKLIDELTSQVKRKFIPMSRIDDAVKRILRVKFTMGLFENPIADHSLAKKLGSKEHRELAREAVRKSLVLLKNGENADKPLLPLPKKANKILVAGTHADNLGYQCGGWTITWQGLNGNNLTIGTTILAAVKKTVDPKTQVIYNQNPDTNFVKAGDFDYAIVAVGEKPYAEGFGDSTNLTISEPGPSTIGNVCASVKCVVVVVSGRPVVMQISNIDALVAAWLPGTEGQGVADVLFGDYGFTGKLARTWFKTVDQLPMNVGDPHYDPLYPFGFGLITKPN

SEQ ID NO: 327 - protein, 141 aa, Arabidopsis thaliana
MADQTRTHHEMISRDSTQEAHPKARQMVKAATAVTAGGSLLVLSGLTLAGTVIALTVATPLLVIFSPVLVPAVVTVALIITGFLASGGFGIAAITAFSWLYRHMTGSGSDKIENARMKVGSRVQDTKYGQHNIGVQHQQVS

SEQ ID NO: 328 - protein, 101 aa, Arabidopsis thaliana
MEMKLLFTSAFTQMFGYSNHMDQASNCQSTRNKIIKMMKKEEFPSGFQVPLHYPKYSKSDYEVMDDLRLDLLLKQYGFSFEGSLEDKRVFAIESFLWPDQL

SEQ ID NO: 329 - protein, 109 aa, Arabidopsis thaliana
MARGSSQSQQSTSTGSSTARPGLAAPRGSAAATAGMRRRRLGGGGGVSSGGGSGVGSGSSNMLRFYTDDAPGLKISPTVVLIMSLCFIGFVTALHVFGKLYLHKSGSQA

SEQ ID NO: 330 - protein, 316 aa, Arabidopsis thaliana
MSSHTNLPSPKPVPKPDHRISGTSQTKKPPSSSVAQDQQNLKCPRCNSPNTKFCYYNNYSLSQPRHFCKSCRRYWTRGGALRNVPIGGGCRKTKKSIKPNSSMNTLPSSSSSQRFFSSIMEDSSKFFPPPTTMDFQLAGLSLNKMNDLQLLNNQEVLDLRPMMSSGRENTPVDVGSGLSLMGFGDFNNNHSPTGFTTAGASDGNLASSIETLSCLNQDLHWRLQQQRMAMLFGNSKEETVVVERPQPILYRNLEIVNSSSPSSPTKKGDNQTEWYFGNNSDNEGVISNNANTGGGGSEWNNGIQAWTDLNHYNALP

SEQ ID NO: 331 - DNA, 306 bp, Arabidopsis thaliana
atgggaataaaacagatcgtcaaagtgatgttcttgtttttatgtgtgatcatggcgttgctctgtcatcatcaatccgaagttcaagcggcgcagaaaccaagtcctgttgcttgctggtcgtcaataaacaaggttcaaggttgtgtggatgctgtgaaagctgccactaaaggagattataaaggtttgagcaaggattgttgcctcgccatctatggcctcatcgacgattgttttccgattgttttcagcggaaaaccagacattgcagtactcgttaaggatgcatgtgctgttaattaa

SEQ ID NO: 332 - DNA, 297 bp, Arabidopsis thaliana
atgggaacaaaacagatcgtcacagtgatgttcttctttttatctgtgatcatggcgttgctttgtcatcatcaatccgaagctcaagcgccgattccaactcccggtgattgcttctcgtcaatcaagaaggttaaaggttgtgcggatgctgtgaaagctgccactaaaggacatcttctacgtttggtcaaggattgttgccacgtcatcaatgaccttgccgacgattgttttccgatcattttccccggaaaaccttacattgccgcactcgttaagcatgcatgttcttaa

SEQ ID NO: 333 - DNA, 1497 bp, Arabidopsis thaliana; identical to SEQ ID NO: 69

SEQ ID NO: 334 - DNA, 1844 bp, Arabidopsis thaliana
acataccacaaaatatctcataaagatcaaataaacactaaacctgaaagcaaaaaaatggcagcacgagcaacattcatattctatgctctcttcctaaccacactccaattccttctaacacaccatgtgtcatccgccgcccgaggattatggaaatacatcgcccccaacgtcggaatctccgcgatgcatatgcaacttctccataacgaccgtgtcgtaatgtacgaccgaaccaacttcggaccatcaaacatctctctacctaacggtaactgccgtgacaacccccaagacgccgtctccaaaatcgactgcacagctcactcgatcgaatacgacgtcgcaacgaacaccatccgacctttaacggtacaatccaacacatggtgctcatccggttcggttcgaccggacggtgttcttgtccaaaccggtggagaccgagacggagaacttaagacaagaaccttttctccttgtaataacaatcaatgtgattgggtcgaaatgaacaacggtttaaaaaagagaagatggtacgcttccaaccatattcttcccgacggtaaacaaatcgtcatgggaggtcaaggacaattcaactacgagttctttcccaaaacgacaaaccctaacgtagtcgcgttaccgtttttggccgagactcatgatcaaggacaagagaataatctttatccttttgtgtttatgaataccgatgggaatctatttatgttcgctaataacagagcgatattactcgactatgttaagaacacggtggtgaaaacttttccggcgattcccggtggtgatccgagaaactatccgagcactggctcagccgtgttattaccgttaaagaatcttgaagcggataatgtcgagacggaggttctagtgtgtggaggtgcaccaaaaggatcatacaacctcgctagaaagaaaactttcgtgaaagcgcttgacacgtgtgcaaggatcaagattaacgatgccaaacctgaatgggcggttgagaagatgccacatgctagagttatgggagatatgattcctttgccaaacggagatgttttgctaatcaacggtggatcttttggtactgctgcatgggagcttggtcgtacaccggttttagcaccagacctataccatcccgagaatccggttggctctaggtttgaatcgctaaggccgactacaatcccgagaatgtatcactccgcggctattcttctacgtgacggtagggttttagtcggaggaagcaatcctcatgcgttttataactacaccggagtgcttttcccgacggagttgagcttagaagctttctctccggtttacctacaacgggagttttcgaatcttcgtcccaagattatatctcctgaacctcagtcgatgattaaatatgggacgaatttgaagttgaaattttcggtcaccggagaagttacgactccggcgaaagtgactatggtatttccgacgttcacgacgcatagcttcgcgatgaatcagagggttttggttttggacaatgttaagtttacgaggaaaggcaaatcgccgatgtatgaggttcaagtgaggactccgaggtcggcgaatattgcatggcctggttattatatgatttttgtggtgaatcaagacataccaagcgaaggtgtttgggtaaagttagaatgattcattgacttttatttaatatctttatttttgtgtgtaattgtgttatattactgatatcaattgtatatgaatgtaataagaatatgtcttctcaacttgatgataataaattaattaactactctttttctatgtcc

SEQ ID NO: 335 - DNA, 1047 bp, Arabidopsis thaliana
actaccaattaaatctctctttttcttctcttaccattttcacattttcgagttttacaccaaagcctcttcactttctctctctctctactatagtctcctactacctactactacttcttctctctctctttcattcactacataaaaagcttcgagctcccatcactatataccctccaaagatgcaattttcaagaaactcaatccttaggcaactaagccgaaaagaaggttggagatcggcttctaaaaggtggacttccggagatagctcaacagccttcaacgacgacacaagtggtggtggttgtggtggtggttactcatcaatggagggtctttatggagtttactccggtggagacacggcggcgagaagtaagagagtgatggttgtagttgatgaaagttcgaggtctaagcatgctatgatgtgggctttgactcatttgactaacaaaggagatttagtgactcttcttcatgttgtgtctcctgatgatgaagctactccttctttggctcaatctcttggttctctttgcaaagcttgtaaacccgaggtggatgtggaggcattggtgattcaaggaccaaagctagcaacagtgttaagccaagtaaagaaacttgaagtctctgttcttgtgttgggtcagaagaaatctgcaccactcatctcttgcttatgtggacctagcagatcagaggagctcgtgaatcgttgcatcaacggtgcagattgtttaacgattggtgtgagaaaacaatgcaaaggtgttggtgggtacttgatcaatacacgatggcagaagaatttctggctcttggcctaatcacaattctaatcttattagataatttgtgttaattctgtgtttattgtagtttaataaactctatgtagtctctttgttgtcttatgttaacctaacttgtcttatatgtcttgtaagaaaaattaaagttgaatctttttatcccactacatcgattcctccgtagtctccaaattcttgtcccatataaacaaatacgttttca

SEQ ID NO: 336 - DNA, 215 bp, Arabidopsis thaliana
atggctaatattgttggaaacactagtgtatctactcgttttaaagagctgattcgtgaaatgacgcagctgaatgaagaaattcagaagatcgacgtgaatgattttcgtgccattagagaagccaggaagaagataactggtatgacaacgaagttggacgagctcttagagatgatgaaagaaactgtgaaggagaagaaggaaaccccaca

SEQ ID NO: 337 - DNA, 696 bp, Arabidopsis thaliana; identical to SEQ ID NO: 151

SEQ ID NO: 338 - DNA, 1894 bp, Arabidopsis thaliana; identical to SEQ ID NO: 90

SEQ ID NO: 339 - DNA, 1356 bp, Arabidopsis thaliana
aaaacaaaaaaaaagaggaagcaattactataggggaaaaaaaaatctgaacaaaatgatgaaactcctcttggtggtggcaacttctgttgcccttatctttagcgtcactgatttatccggtgagggaccaaaacatggaggagaatccatgttgacagtccaaatccctgatttccgtctgattcctaccaccggagctttgggaccggagagttttgtctttgattttttcggcgatggtccttacaccggtttatctgacggtcgaattgttaagtggctagctaatgagagccgttggatcgatttcgccgtcaccacctccgcaagagaaggttgtgagggcccgcacgagcaccaacgaacagaacacgtgtgtggacgaccattgggccttgcctttgacaaatccactggtgacctttatatagccgatgcttatatgggccttcttaaagttggcccaacaggtggtgtcgccactcaggtgttaccacgtgagctaaatgaggcccttcgatttaccaattctttggatatcaatccacggaccggagttgtctactttaccgacagtagttcggtttatcaacggaggaactatataggggcgatgatgagtggggacaaaactggtagactgatgaagtacgacaacacgaaacaagtgaccactcttctaagcaacttagcgtttgtaaacggtgtcgctttaagccaaaacggtgattaccttctcgtcgtcgagaccgccatgtgtcgtatcttacgttactggctcaacgaaacgtcggtaaagtctcaatctcacgataactacgagattttcgcggaggggctccctgggtttccagacaacataaagagaagtccacgtggcggattctgggtaggcttgaacacaaaacactcaaagctgacaaagttcgccatgtcgaacgcgtggcttggacgtgccgctttgggcctgccggtggattggatgaaggtccattcggtttgggccaggtacaatgggaacggcatggccgtgaggttgagcgaggatagtggcgttatattagaggtattcgaaggtaaaaatgaaaataagtggatatctataagtgaggttgaagaaaaagatggaactctttgggttggatcggtgaatactcctttcgctggcatgtataaaatctaaaattgagtaatacaaatatgtttttccaacaatatgattcatatatagataattagacgatacatcccccctccccctattcttattttttaggataacaactaataagtccgtttagtaccactttatattgtgctaggtagctacatgcatgccttttgataatttaa

SEQ ID NO: 340 - DNA, 715 bp, Arabidopsis thaliana; identical to SEQ ID NO: 52

SEQ ID NO: 341 - DNA, 1673 bp, Arabidopsis thaliana
aaaaacaaacacatcaacaaaacaacaagaaaaaatggcaataaccaacaaattaatcataacacttcttctccttatctccatagctgtcgtccactgcttatccttccgtgtggagatcgacgagttcgagccaccacagcaaggagaacaagaaggtccccgtcgccgtcctggtggtggctctggcgagggatgggaggaagagtcgacgaatcatccataccacttcaggaagcggagtttcagtgattggttccagtcaaaggaaggttttgtgagagtgctgcctaagttcacaaaacatgcaccggctctcttccgaggaatcgagaactacagattctcgttggtggagatggagccaacaactttctttgtgcctcaccatttggatgccgatgctgtttttatagtcctacaaggtaaaggagtgatcgagtttgtgacggataaaacaaaagaatcgttccacataactaaaggtgatgtggtaagaatcccttctggtgtcaccaactttatcaccaacactaaccagacggttcctctccgcctcgcccagatcaccgtccctgtcaacaatcccggcaactacaaggattacttccctgctgcatcccaatttcagcaatcctacttcaatgggtttaccaaagaagtcctctctaccagtttcaacgtgccggaagaattgctagggagattggttacgagatcaaaagaaattggtcaagggattatccgaagaatttctccagaccaaatcaaggaacttgctgagcacgctacatctccttcaaacaaacacaaagccaaaaaagaaaaggaggaagacaaagacctaagaacgttgtggactcctttcaatctctttgcaatagatccaatctactccaacgactttggtcatttccacgaggcacatcctaagaattataatcaactgcaagaccttcacatagccgccgcttgggctaacatgacacagggatccttgttccttcctcattttaactctaagaccacatttgtaacgtttgtggagaatggttgtgcccgcttcgagatggctactccttataaattccaaagagggcaacaacaatggccaggacaaggacaagaagaagaagaagatatgagtgaaaacgtacacaaagttgtgtcacgagtgtgtaaaggcgaagtttttatcgttccggcaggtcatccattcactatactctcgcaagatcaagactttatcgcggtagggtttggtatttatgcgaccaacagcaaaagaacgttccttgcaggggaagagaatttgctgagcaacctcaacccggcggcaactagggtaacctttggtgttggaagtaaagtcgcggagaaactgttcacgagccaaaactattcctactttgcacctacgagtcgtagccaacaacaaattccagagaaacacaagccatcgtttcaatcaatcttagactttgctggtttttgaaaatgcttttttacagtcctaagaaaggaaagagtttaagagtttaatataatctttgtgaagatatgcaataaaatatggtaacgctctgcatgtaacttctatgtactggtttcttgagttgtaaatttttatgtgacagttttaataaaaccaacggtttagttataacccataa

SEQ ID NO: 342 - DNA, 1610 bp, Arabidopsis thaliana
atgggttcatgcagtcctcaactaccactcatctgtctctcggaccaaaccctaaaaccaggaagctcaaaatgggttaaagtgaggagtgatgtccgtaaagctttagaagactacggttgtttcgaagccaaaattgatcaagtgtcaatggagcttcaggggtcggttttgaaggccatgcaagagctttttgcgttaccgacagaggccaaacaaagaaatgtgtgcccgaaacctttcgctggatatttttctcataatggtctctccgagagttttgggatcaaggatgctaatattttggagaaagctcacgaatttactcaacaactatggcctgagggtaacaagagtatcagtaagatgatccaactgtatgctgagaaattagcagaactggatatgatggtgagaagattaatactggagagctatgggatagaatacttcattgatgaacatttgaactcaacgtattaccgtatgcgattgatgaagtatatagcacggcctgataatgatataactgctgctgttggtgctaatgtggataatggtgctaacgataatgccgatggtgatgctaatgtcaacgatgatggtgctagtattggtgttaaagttaatgtcgatgttggtgatgatgttaatgacaatgatagtgttaatattggtgttggtgttgatattaacgttgagaccaatgttaatggtgatcttgatgctgaagctaatggtgatgctactgcttgggtcgttggtgctgttagtgggaatgctagcgttggtgccaaagaagctaatgttgatgcggagttgggcttacctagtcatactgataaaagccttagtggaataatttatcagcatcaaattgatggtttggaggtgaagaccaaagaggggaagtggatcagagttaaaccagctcctaataccgtcattgttattgcgggagatgctctatgtgcacttatgaatggtagaatcccttcaccgtatcaccgagtaagggtaacagagaaaaagaagacgagatacgcagcagcattgttttcgaatccaaaagaaggttatatcatagattcaccaaaagaacttgtggacgagaagcatccacgtgccttcaaaccctttgattttgtcgacctttttaacttctatcacacagaagctggtcgtagagctccatctactctccaagctttttgtggcgtctctgctgggaaataaaggtgtgcgcttcaaaatgtttggacgtggtttcaagtttcaactagtatcaacaactatcttacgaaataaggtgtttatgttgtgtaataaacatttaggtatatgtttgaattttgtctttgtatataggtaacaacactttgattacttcttttgtttcatgacgttaattcagccacaaaccggataacctgacctcagtgtaagagattgtcttttcttgttcctagaaacatgtggcctaaaccagaagcgcatattgatatagttaatagttctggaacaataaaagacattttcctagcatgtaaaagtgtagcatgatgtctttgtttcagccacaaacttagcaactaatatagttggtattt

SEQ ID NO: 343 - DNA, 2132 bp, Arabidopsis thaliana; identical to SEQ ID NO: 62

SEQ ID NO: 344 - DNA, 2375 bp, Arabidopsis thaliana
gaatacatggagaatcacagctgccttcagaaagatacgacgtcggcggccaaattagacgtcgaaactggaaacctccggcagagagatgaaacgaagccgttttatgcaaactcactgacgccacgtgagatggaatctcttgttgcgatctgcgataccttcatatcctccatcgacgactctggagtaggacacgtggatgattgcgtcgctggatatttctccgcctccgcttctcagaccggaactcccgaccgcgtggcgaggttaatgagtgagagacttcaccacccaaagaagtggatactaagagctggattgtggttactctctacttggatcggaagtctagtcttgtgtggttggagaagtttcaccggcgagtttccttacttccggagattctgccggcttccggagaaacggagagaagagatattgctgaattggtcttcaagctatttctcacttcttagaatgttatttaggaccatcaaacttataagtgcccttgtcttcttcactcaggttgatgaaaaaggaaggaacttggcgtggaaagcaataggttacaatggacccagccctgatcatagtgatcatgaagtagaactaaacgaggagaagaagaagaagaaacctgaggagatctttggaccactttacaatggcatcgttgatctaaaaagccctagagaagccgtggaaaagaagctagccggtcgtgggttcgcagtttcaaatcaaaagaggaatacaaacggatcatctatctctgacccggtgatgaaaatccagtgtgatgctgtggtggttgggtctggatccggtggaggagtggcggcaggagtgttagccaaggctggttacaaagtgttggtgattgagtcagggaattactatgcaagaagcaaactttctttacttgaagggcaagctatggatgacatgtatttatccggtgggttattagcgacgtccgatacgaacgtagtgattcttgcgggatccacagtcggaggtggttctacaatcaattggtccgcctcgatcaagacaccagaacatgtgatgaaggaatgggcagaaaagtcaaaactcgaaatgttcggaagtgatttgtatcgagaggcaatggatgttgtctgtaagaggatgggtgttcaatgcggatttgtagaagaagggtttaataatgaggtattgagaaaaggttgtgaaaagttagggttaccagtgaagaatattccgaggaatgctccatccgatcattactgtgggttttgttgcttgggttgcaagaaaggtcaaaagcaggggacttcagagacttggcttgtagatttggtggaatctgataatggtttaatccttccaggttgtcaagcgacggaagtcatgtacgactgtgaacaggggaagaagaagaaggcaactggagttgcgtttgcgtttggggaagagatttatgtggtggagtctagagtgacaatagtggcttgcggtgcgcttagaacgccgcatctgttgaaacgtagcggtttgaagaatagtaacattgggagaaacctttgtctacatccggttgttatggcttggggatggtttccagaggaagataagtggccggaaaagaagaaaaagagctacgaggggggaataatgactgcgatgtctagcgttgtaattgaagaaacgcatagttcttatggtgaaatggttatccagacacctgctctacatccaggaatgttctcagggatcattccctggacatcaagcaaggatttcaaaacccgaatgctcaaattttcaagaaccgcacacatttttgcgcttctgagagataaaggaaccggaacaatagattccaagacctacattgactacaacttaaacgatgaagacgaagagagtctaaagaacggtcttgaaagagtcttgaagattctggccgcagccggagccgaggagattgggacgcatcattcagaaggtaggagtctgaatgttagaacagcgagttcgttagagattgagcggtttgtgagagaagagagttcaaagccgttgaaggatttgtcaggtcagatatgttcagctcaccaaatgggaagttgtaggatgggaattaggccggaggaatccgcggtgaggccaacaggagagacttgggaggtcgaaaggttatttgtggcggacacaagtgtttttccgaccgctttaggggttaatccgatggtcaccgttcagtctattgcttattgtattggacttaatgttgttgatgttcttaagaagaagaagtgagggttcatcagtttgaaatagattttagttttccacatattttttaaaatgaaatgtttttt

SEQ ID NO: 345 - DNA, 827 bp, Arabidopsis thaliana
ctccatatgtctcatgcacacatctctccctctctttccttccctctctctctctcactctcccaagacaataatgccaaacgcgggatctgagcgggcagcttcactctcactgaaaaagcaagacaccgccaccttctccggtaagctaccgtcgaccaaacaacgtttttcgtcggtatcagctgcttgtccttcctttagaatctactactacgacggagccgccggtgccgtccctttcgaatgggaatctcatccaggcacacccaaacacccctcctctgagctacctactctgccacctctcactcctccgccgtctcatttctctttctccggcgaccaaatccgccgccgttccaaaaagtccaccaagaaaatcctcgcactaatcccgacaaggctcttctggctatcgggcgatcacaatggtaaggctaagaaactgtcggcttcatcaccaccatctctgtcggagagagtgttgatcgacgaaaatgagtacgatctgttcaagtttcaaacagaaaggaatgtcatgcgaagattttcatccttcgactcttctgctgactacccaattcagagatcacaatccacttcctgcttcggaatccgcagatgtttcctctgctaattccgctgcaaaatttggaaaataaaacgttgaaattttataaaatgtttttcatatattagtttattttgtgttccatcgtcttattattataatatttaatcagtttgtgtcggtaatgcaactccgaatcatataatacgtttacctttttgttaaataagagcaatgaacagttacaagagtt

SEQ ID NO: 346 - DNA, 2176 bp, Arabidopsis thaliana
ccgagacgttttggccttcttctcttccgaaatctgatacagtaacagaaacgaacctaatgccgcctcgccggagttaccccttcagtggtcacggaggtacaattgcacgattcattgaatttggggaagcatttggacactatggagaagaagaagacgaagaagaggaagacgaagaggaagcatatgtcgactatggtgaagtacaagaggaagacgaggaggaagaggaggaagaagattccgaacgccaaaccagggaatacatcgatgtcctagactcacctgttagggtttcacagaacgagagtgaagggatagagaatcagaataggtcacaaggtgtttgttcatcgtcttccggatcgcaggaggatgtcgaatggaaacaaggtgacactgagggattgtcttgttctatctgtatggaagtttggaccagcggtggccaacaccaagtctgttgtcttccctgtggacacttgtatggatattcctgcatcaacaagtggtttcagcagcgacgaagtggagggaagtgtcccctgtgcaacaaaatatgtagcttgagagatgtccggaaaatctatgcatcacgggttgctgcagtagatgatgaagcacacaagagaatcttatttctggaggccaagttaaggtcaattgaacagaagactgcgagttggagtaacaaagaagttcaatggaaaataactgaagctgagctacgattagaagttactaagctgaagaagaaaatagctaatatggaaagtacgactaagggttcgcaaagccagtctaatgtggcttctcaggagaaatatatacctgctcataatatctaccaagagcatcatggacagtcaccttcttgcagcttcagacatcagggagatctgctaataaacggtggccgtatatttgacatagatggtggtagacaaatattattatatgcccgtaggctctcaggcgttggtggaacgtttgtgcttacgcaaatgagcctacattcgccttgtgagattgatgatattttgttgcctcgtaccactagagcaattaaagatcttcacctttcccctcacaataatgggcttgcagtatttgggtctctaggaaaaaaattatctgttataagcttggagagccacaatactgtcttatcttatgatctaccggctgcaccttggtcttgctcgtgggatctcaaaagctctcaccatatttatgctggactacaaaatggaatggttttgatatttgacatgcgtcaaaccacgggacctttcgcatcgatgacaggcttaacaaccaatccagttcatactgtccatcatctctctggcaattccactccaacttctgatgtccgtaccctcttatctgcttcttccatcgggctgtgtcagtggaacattagtggtagcgagggaagcccatcattagtttcggaaacgggaaacccaggtgtatgcatatcctcctcgtactgtccccgcagcaatcatatagtagcttcttatagaccaagagttggatcatctgatgatacagtcccgactcagccctcattgactcaaacaggagtcagtaatagtaatagtaatggtgtagatggatttcatgtttgtcacaagagaagaggtgttgattcgtattaccagaaactatcctccacacaagctattgtagatcccatccgtttgccaagaacagcgattatagactttggtggggaaaggaaacaactttttgcatcttgtgacgagtccactcgggagctcatcttgcaagatccttcgacttttactatttctcaacggttgccattgtcaagtcatcttccgcttcaagatgtgaaatactgtcacgtcaatggttcggatctgctcggtctcttaacggatgatagattgcagattcttaggaacgaatctccatgaagattaaaaaagattgatagtcttgcaaggatggtgtttgttgaagagaaaacatgtatgtaaagcggctaactagtctatctatcttttgtaatctggagatgctatagagtagcgagccattacttaaatattattatcttagttatgaacctattgctgcaatgcagcctgctccttttttgtatatacgtattacttaaatcagtttttttttctttatc

SEQ ID NO: 347 - DNA, 942 bp, Arabidopsis thaliana
gtcgcagctgatgacaacaaacatcaagcatttataatttatataacactcacgagagcctctttctttatctacctcgtctcctaatcacaaacacacacaaatctctgaagtaaaatgacgttcccttctctttctgtctcatttctcttctttgccttcatattcgttacgcatgcattcgacctcagcatcatccagatgcaacagggaacatgtccgtacacggtggttgtcatgacaagctgtctttctccggagtcgacaagagatcagatcagcattgtttttggcgatgccgacggtaacaaggtgtatgcaccgaaactagggggtttggtaagaggaccagggggtttggggaagtgttcaacgaacacattccaagtcagaggtcaatgtttgaatgaccctatctgctctctctatatcaaccggaatggacccgacggttgggtcccggagtccattgagatctactcagaaggttcaaagtccgttaaattcgatttcagcaagagcgtccctcaactaaacacttggtacggccacaacaactgcaacaccacaggcagaccatcgtctcccgatctgcctccaccacattttccgccagagtttccaccggagacacctaccaccccaccgccgcctccaccaaggccgtctgctgcttcaaggcttggaaatggtgagagtgttttccttgcgtttgccattgcgactgcgattgccgcaatggtgcgttggagttactagcatggtacttgaagagcatgttgttgggttgtatgaggctttttctttccgtcgaatgtttttatttgctttcgttttgcttcagccttttccttgttgtagaaaacataattacttattaagtatgtgcgcatgagttcctgtttagctatgattattaatcagttggtaccgacatttagt

SEQ ID NO: 348 - DNA, 1262 bp, Arabidopsis thaliana; identical to SEQ ID NO: 106

SEQ ID NO: 349 - DNA, 1868 bp, Arabidopsis thaliana
tttgtggaacaactggtttcgcttcttcttctacagagcttccctcgtttcctccgccggagagacactccattaaaatcccttcttcatcgatccttcattagatttacaacaacaacaatgccaagcgtcaagctcacacaccattctccacctgacactattgcctccgactccgtccgtctcctttcccgtgaaactctccgaatcagcgcctctctcgcttctcctcccgttgatgatctcctctcctcactctcctccacctccagattctcaatttcttcattcgactctgagattgatctgttgcgaagaaatcgatggccgtcggtttaagtatgtcgctgagagcgatggttctgggagattcaagaagaattcagttcgtgctattagcttggagtctcctcagactccttttgatgaagtgggttcgtttcttagatcttacgttgtacctgaaggctttcctgggagtgttaatgagtcttatgttccttatatgacttggagagctttgaaacatttctttggtggagctatgggtgtgtttactactcaaactcttcttaattctgttggagcttcaagaaacagttctgcttctgctgctgttgccatcaattggattctcaaggatggtgctgggcgtgttgggaaaatgctttttgcgaggcagggaaagaaatttgattatgatttgaaacagttacggtttgctggtgatctattgatggagctcggtgctggtgtagagttggcgacggctgcagttccacatctttttcttccactggcttgtgctgctaatgttgttaagaatgttgcagcagtaacatcaacgtctactcgtacaccgatctataaagcctttgctaaaggagaaaacataggagacgtaactgctaaaggagagtgtgttggtaatattgcagatctgatgggaactgggtttagcatcctgatatcaaaaagaaatccttcgttggtcacaacatttggtcttctatcatgtggctatctcatgagctcgtaccaagaggttagatctgtagtattgcatacactaaaccgtgctagatttacagtagcagtggagtcctttcttaagacggggcgggttccctcattgcaggaaggtaatatccaagaaaagatattcacttttccatgggtggatgatcggccagtgatgcttggagccagatttaaggatgcattccaagaccccagcacgtatatggctgtaaagccttttttcgataaagaaagatacatggtaacgtacagccctaccaagggtaaagtctatgcactgctcaaacatcaggctaactcagatgacattctcaaagcagcatttcatgcacatgtgcttcttcatttcatgaatcaatcaaaagatggtaacccaagatcggtggagcaattagatcctgcgtttgctcctacggaatatgagctcgagtctcgtattgctgagtcgtgtgaaatggtttccacatcatatggcgtcttcaaaagcagggctgcagaacagggttggagaatgtcagaatctctgcttaatcctggccgggctaggttatgtcatgtgaaggagggggagtaaacatcgcctgttgagactggtcatcgacctgaatcggcttttatagttatttcactgtcacactctaaattttgctgtcttggtttcatgaagaaaaaaacaggttttggttggtacacgttttattaaccaggctgtaaaaaatagaacgatatgtagcttttgtaaattgtgagaatgccactggtgtaatttaacagatgaatcttctttgtgtaccaattctcacatcatgattgttacacaggttcat

SEQ ID NO: 350 - protein, 101 aa, Arabidopsis thaliana
MGIKQIVKVMFLFLCVIMALLCHHQSEVQAAQKPSPVACWSSINKVQGCVDAVKAATKGDYKGLSKDCCLAIYGLIDDCFPIVFSGKPDIAVLVKDACAVN

SEQ ID NO: 351 - protein, 98 aa, Arabidopsis thaliana
MGTKQIVTVMFFFLSVIMALLCHHQSEAQAPIPTPGDCFSSIKKVKGCADAVKAATKGHLLRLVKDCCHVINDLADDCFPIIFPGKPYIAALVKHACS

SEQ ID NO: 352 - protein, 498 aa, Arabidopsis thaliana
AAATNTLIYIATVLPYIYSPLKIFPLIYNPNLFCFINMCLPFRPVSKTYYSSSSSTIVTRMVNCILLFVFILLVYLLISASRLQSKNSIHAYFSSSDQDQSQSPTKIEHIVFGIGSSAISWRARREYVKLWWDAQKMRGCVFVERPLPSSQNHTDSYLLPPVCVSQDTSRFRYTWRGGDRNAIRIARCVLETVRLFNTSSEEVRWYVFGDDDTIFIPENLARTLSKYDHTSWYYIGSTSEIYHQNSMFGHDMAFGGGGYALSSSLANVLARNFDSCIERYPHLYGGDSRVYACVLELGVGLSKEPGFHQFDVRGNALGILTSHSTRPLVSLHHMAHIDPIFPNSTTFSAVRHLFSAVQLDPLRIFQLSVCYDRWYSWTISVSWGYTVQIDGRHLFLRDVLRAQETFRPWQKSGGLASVYTFNTREIHRDPCQRPVTFYMQHVSSSSHDGTIKSVYKQAYENCTYDPVTSPRKIHEIRVFSRRLDPNIRQQSPLEKIIF

SEQ ID NO: 353 - protein, 567 aa, Arabidopsis thaliana
TYHKISHKDQINTKPESKKMAARATFIFYALFLTTLQFLLTHHVSSAARGLWKYIAPNVGISAMHMQLLHNDRVVMYDRTNFGPSNISLPNGNCRDNPQDAVSKIDCTAHSIEYDVATNTIRPLTVQSNTWCSSGSVRPDGVLVQTGGDRDGELKTRTFSPCNNNQCDWVEMNNGLKKRRWYASNHILPDGKQIVMGGQGQFNYEFFPKTTNPNVVALPFLAETHDQGQENNLYPFVFMNTDGNLFMFANNRAILLDYVKNTVVKTFPAIPGGDPRNYPSTGSAVLLPLKNLEADNVETEVLVCGGAPKGSYNLARKKTFVKALDTCARIKINDAKPEWAVEKMPHARVMGDMIPLPNGDVLLINGGSFGTAAWELGRTPVLAPDLYHPENPVGSRFESLRPTTIPRMYHSAAILLRDGRVLVGGSNPHAFYNYTGVLFPTELSLEAFSPVYLQREFSNLRPKIISPEPQSMIKYGTNLKLKFSVTGEVTTPAKVTMVFPTFTTHSFAMNQRVLVLDNVKFTRKGKSPMYEVQVRTPRSANIAWPGYYMIFVVNQDIPSEGVWVKLE

SEQ ID NO: 354 - protein, 217 aa, Arabidopsis thaliana
MQFSRNSILRQLSRKEGWRSASKRWTSGDSSTAFNDDTSGGGCGGGYSSMEGLYGVYSGGDTAARSKRVMVVVDESSRSKHAMMWALTHLTNKGDLVTLLHVVSPDDEATPSLAQSLGSLCKACKPEVDVEALVIQGPKLATVLSQVKKLEVSVLVLGQKKSAPLISCLCGPSRSEELVNRCINGADCLTIGVRKQCKGVGGYLINTRWQKNFWLLA

SEQ ID NO: 355 - protein, 71 aa, Arabidopsis thaliana
MANIVGNTSVSTRFKELIREMTQLNEEIQKIDVNDFRAIREARKKITGMTTKLDELLEMMKETVKEKKETP

SEQ ID NO: 356 - protein, 133 aa, Arabidopsis thaliana
TKILKINYKPKTMNLAIKFHVMVLLLIVIGDVCANVGARPLEEVSKELMDKKAVSIPKTPLPLPPPLPTLPPAQLPGLPTPPKMSNGDTGGVDANADGRLPKDAPAGSHGATARGYRSGGGRSDASGSTDPWP

SEQ ID NO: 357 - protein, 594 aa, Arabidopsis thaliana
TINTVSIQNHHVHIKKSPNTKMVLFTLSTTSSSSSKLKQHSHQSFSESLMEHTIEDAESIIHRWISPEHVHSSSFCFISSLFSTENREEAKRFIDAVTTLHSGMIRLISVNPTSMKLVKAENLMRISMTHLSKEFYRILKSNRRYLDPESVSIRSSKASDSDSDSDSNTMDDLKMIADCMISSGYSKECFKIYKRIRKSIINEALNQLGFENLTFSQIQKLEWEVMEKKIRKWLRTTTRAVNTLFSGEQILSDHVFSSSSSTIRESAFAEITSQTALALFTFPEKMAKCRKSPEKIFLTLDVYQTIVDLLPKINELFSSDSTSTVRSQVDLTLVNLREGVVSMIDEFESSISKESSKSLISGGGIHQLTRYVMNFIVFLADYSDTLSDIISKPSLPSPEEEKDSGDSSPVKSRISRLILFLLCKIDAKSRLYNDVALSYLFLINNVNYVVVKVRSSNLKTVLSEDWVKKHEAKVKKYVAKFEEIVWGEMMTSLSDDVTMTAEEGIKRFSDGFEEAYKRQTGWIVPDSKLRDEIKRSVGMMIIPRYSGFCERNRVRLLENVGFDPEDIGNYLSDLYFGSGGSGSGSSVHSSGSSV

SEQ ID NO: 358 - protein, 394 aa, Arabidopsis thaliana
KQKKRGSNYYRGKKNLNKMMKLLLVVATSVALIFSVTDLSGEGPKHGGESMLTVQIPDFRLIPTTGALGPESFVFDFFGDGPYTGLSDGRIVKWLANESRWIDFAVTTSAREGCEGPHEHQRTEHVCGRPLGLAFDKSTGDLYIADAYMGLLKVGPTGGVATQVLPRELNEALRFTNSLDINPRTGVVYFTDSSSVYQRRNYIGAMMSGDKTGRLMKYDNTKQVTTLLSNLAFVNGVALSQNGDYLLVVETAMCRILRYWLNETSVKSQSHDNYEIFAEGLPGFPDNIKRSPRGGFWVGLNTKHSKLTKFAMSNAWLGRAALGLPVDWMKVHSVWARYNGNGMAVRLSEDSGVILEVFEGKNENKWISISEVEEKDGTLWVGSVNTPFAGMYKI

SEQ ID NO: 359 - protein, 224 aa, Arabidopsis thaliana
ERERETMEGKGKEIVVGHSISKSSVECHKYYLARRTTMEMLRDRGYDVSDEDINLSLQQFRALYGEHPDVDLLRISAKHRFDSSKKISVVFCGTGIVKVNAMRVIAADVLSRENITGLILVLQSHITNQALKAVELFSFKVELFEITDLLVNVSKHVLRPKHQVLNDKEKESLLKKFSIEEKQLPRLSSKDPIVRYYGLETGQVMKVTYKDELSESHVTYRCVS

SEQ ID NO: 360 - protein, 497 aa, Arabidopsis thaliana
KTNTSTKQQEKMAITNKLIITLLLLISIAVVHCLSFRVEIDEFEPPQQGEQEGPRRRPGGGSGEGWEEESTNHPYHFRKRSFSDWFQSKEGFVRVLPKFTKHAPALFRGIENYRFSLVEMEPTTFFVPHHLDADAVFIVLQGKGVIEFVTDKTKESFHITKGDVVRIPSGVTNFITNTNQTVPLRLAQITVPVNNPGNYKDYFPAASQFQQSYFNGFTKEVLSTSFNVPEELLGRLVTRSKEIGQGIIRRISPDQIKELAEHATSPSNKHKAKKEKEEDKDLRTLWTPFNLFAIDPIYSNDFGHFHEAHPKNYNQLQDLHIAAAWANMTQGSLFLPHFNSKTTFVTFVENGCARFEMATPYKFQRGQQQWPGQGQEEEEDMSENVHKVVSRVCKGEVFIVPAGHPFTILSQDQDFIAVGFGIYATNSKRTFLAGEENLLSNLNPAATRVTFGVGSKVAEKLFTSQNYSYFAPTSRSQQQIPEKHKPSFQSILDFAGF

SEQ ID NO: 361 - protein, 411 aa, Arabidopsis thaliana
MGSCSPQLPLICLSDQTLKPGSSKWVKVRSDVRKALEDYGCFEAKIDQVSMELQGSVLKAMQELFALPTEAKQRNVCPKPFAGYFSHNGLSESFGIKDANILEKAHEFTQQLWPEGNKSISKMIQLYAEKLAELDMMVRRLILESYGIEYFIDEHLNSTYYRMRLMKYIARPDNDITAAVGANVDNGANDNADGDANVNDDGASIGVKVNVDVGDDVNDNDSVNIGVGVDINVETNVNGDLDAEANGDATAWVVGAVSGNASVGAKEANVDAELGLPSHTDKSLSGIIYQHQIDGLEVKTKEGKWIRVKPAPNTVIVIAGDALCALMNGRIPSPYHRVRVTEKKKTRYAAALFSNPKEGYIIDSPKELVDEKHPRAFKPFDFVDLFNFYHTEAGRRAPSTLQAFCGVSAGK

SEQ ID NO: 362 - protein, 649 aa, Arabidopsis thaliana
MVSYSENNSRPIMKKAHFLKPFVTSSIDGFQGMLRPSPSPELKASSLSVSFRGWRLPNKKFQFWVKKMVALHKPTWLKSGIFEAIKASTYRIHKNPSLILSLAQNWCPETNTFVFPWGEATITLEDVNVLLGFSISGSSVFASLQSSEMKEAVEKLQKRCQGSMKQESWISSFVDDEMEHEAFLVLWLSKFVFPDKFCSSISSDVFPLAVRLARGERIAFAPAVLANLYNDLGHICVLASIQNVLASSLFKLVQVWIWERFKSIRPEAKVIPRGQPRIAQWSGLKQRFKNVGLIIFHGNFDWRPYSEPLENWNPPRFYVEEAKWVRIDESLDGDYDDDDEFVSFARCVRVSKLVGIGVVENYYPNRVAMQFGLAQDVPVLGTNHRRNFTEEEAWDDYNKPLVGLKLYFPSRVATASVTTRYRDWWAKSVSEMRKESMETFNVSSTVDHYDDSDDDIPLKIVPLSQVYQKLDDEMKKAKHSTNKRRKRAREDDESAAETEDDESADTEDDESADTEDDESAETEDDDNMTIAQRINSRKKSDDIENTEGERSRLVADNNVSGLPQKLAYGDETVATTQEETEQKNNENKSSNGVAAEKEEDDERLKQRKLAIKELALKTEARMLKVENTLAKIKQWKLTRLHTKKPLVSS

SEQ ID NO: 363 - protein, 770 aa, Arabidopsis thaliana
EYMENHSCLQKDTTSAAKLDVETGNLRQRDETKPFYANSLTPREMESLVAICDTFISSIDDSGVGHVDDCVAGYFSASASQTGTPDRVARLMSERLHHPKKWILRAGLWLLSTWIGSLVLCGWRSFTGEFPYFRRFCRLPEKRREEILLNWSSSYFSLLRMLFRTIKLISALVFFTQVDEKGRNLAWKAIGYNGPSPDHSDHEVELNEEKKKKKPEEIFGPLYNGIVDLKSPREAVEKKLAGRGFAVSNQKRNTNGSSISDPVMKIQCDAVVVGSGSGGGVAAGVLAKAGYKVLVIESGNYYARSKLSLLEGQAMDDMYLSGGLLATSDTNVVILAGSTVGGGSTINWSASIKTPEHVMKEWAEKSKLEMFGSDLYREAMDVVCKRMGVQCGFVEEGFNNEVLRKGCEKLGLPVKNIPRNAPSDHYCGFCCLGCKKGQKQGTSETWLVDLVESDNGLILPGCQATEVMYDCEQGKKKKATGVAFAFGEEIYVVESRVTIVACGALRTPHLLKRSGLKNSNIGRNLCLHPVVMAWGWFPEEDKWPEKKKKSYEGGIMTAMSSVVIEETHSSYGEMVIQTPALHPGMFSGIIPWTSSKDFKTRMLKFSRTAHIFALLRDKGTGTIDSKTYIDYNLNDEDEESLKNGLERVLKILAAAGAEEIGTHHSEGRSLNVRTASSLEIERFVREESSKPLKDLSGQICSAHQMGSCRMGIRPEESAVRPTGETWEVERLFVADTSVFPTALGVNPMVTVQSIAYCIGLNVVDVLKKKK

SEQ ID NO: 364 - protein, 188 aa, Arabidopsis thaliana
MPNAGSERAASLSLKKQDTATFSGKLPSTKQRFSSVSAACPSFRIYYYDGAAGAVPFEWESHPGTPKHPSSELPTLPPLTPPPSHFSFSGDQIRRRSKKSTKKILALIPTRLFWLSGDHNGKAKKLSASSPPSLSERVLIDENEYDLFKFQTERNVMRRFSSFDSSADYPIQRSQSTSCFGIRRCFLC

SEQ ID NO: 365 - protein, 649 aa, Arabidopsis thaliana
ETFWPSSLPKSDTVTETNLMPPRRSYPFSGHGGTIARFIEFGEAFGHYGEEEDEEEEDEEEAYVDYGEVQEEDEEEEEEEDSERQTREYIDVLDSPVRVSQNESEGIENQNRSQGVCSSSSGSQEDVEWKQGDTEGLSCSICMEVWTSGGQHQVCCLPCGHLYGYSCINKWFQQRRSGGKCPLCNKICSLRDVRKIYASRVAAVDDEAHKRILFLEAKLRSIEQKTASWSNKEVQWKITEAELRLEVTKLKKKIANMESTTKGSQSQSNVASQEKYIPAHNIYQEHHGQSPSCSFRHQGDLLINGGRIFDIDGGRQILLYARRLSGVGGTFVLTQMSLHSPCEIDDILLPRTTRAIKDLHLSPHNNGLAVFGSLGKKLSVISLESHNTVLSYDLPAAPWSCSWDLKSSHHIYAGLQNGMVLIFDMRQTTGPFASMTGLTTNPVHTVHHLSGNSTPTSDVRTLLSASSIGLCQWNISGSEGSPSLVSETGNPGVCISSSYCPRSNHIVASYRPRVGSSDDTVPTQPSLTQTGVSNSNSNGVDGFHVCHKRRGVDSYYQKLSSTQAIVDPIRLPRTAIIDFGGERKQLFASCDESTRELILQDPSTFTISQRLPLSSHLPLQDVKYCHVNGSDLLGLLTDDRLQILRNESP

SEQ ID NO: 366 - protein, 213 aa, Arabidopsis thaliana; identical to SEQ ID NO: 323

SEQ ID NO: 367 - protein, 374 aa, Arabidopsis thaliana
MMMMSCTVQTLVLVPWFLVVFVLAGGEDSSETTAMFPAMFVFGDSLVDNGNNNHLNSLARSNYLPYGIDFAGNQPTGRFSNGKTIVDFIGELLGLPEIPAFMDTVDGGVDILHGVNYASAAGGILEETGRHLGERFSMGRQVENFEKTLMEISRSMRKESVKEYMAKSLVVVSLGNNDYINNYLKPRLFLSSSIYDPTSFADLLLSNFTTHLLELYGKGFRKFVIAGVGPLGCIPDQLAAQAALPGECVEAVNEMAELFNNRLVSLVDRLNSDNKTASEAIFVYGNTYGAAVDILTNPFNYGFEVTDRGCCGVGRNRGEITCLPLAVPCAFRDRHVFWDAFHPTQAFNLIIALRAFNGSKSDCYPINLSQLSRL

SEQ ID NO: 368 - protein, 458 aa, Arabidopsis thaliana
MISSPHSPPPPDSQFLHSTLRLICCEEIDGRRFKYVAESDGSGRFKKNSVRAISLESPQTPFDEVGSFLRSYVVPEGFPGSVNESYVPYMTWRALKHFFGGAMGVFTTQTLLNSVGASRNSSASAAVAINWILKDGAGRVGKMLFARQGKKFDYDLKQLRFAGDLLMELGAGVELATAAVPHLFLPLACAANVVKNVAAVTSTSTRTPIYKAFAKGENIGDVTAKGECVGNIADLMGTGFSILISKRNPSLVTTFGLLSCGYLMSSYQEVRSVVLHTLNRARFTVAVESFLKTGRVPSLQEGNIQEKIFTFPWVDDRPVMLGARFKDAFQDPSTYMAVKPFFDKERYMVTYSPTKGKVYALLKHQANSDDILKAAFHAHVLLHFMNQSKDGNPRSVEQLDPAFAPTEYELESRIAESCEMVSTSYGVFKSRAAEQGWRMSESLLNPGRARLCHVKEGE

SEQ ID NO: 369 - DNA, 507 bp, Arachis hypogaea
cacgcgcatacccacttcaaatcaataaggttggggagtctctctgccggaagggaaacagaaaaccctcttttcgttttccggcgatatcgttctttcttccaaccgtttccggccatctcatctcccagcaaccatgacgacatcaaggcgacttgcggacaggaaagtagagaagtttgagaagaacatcacaaaaagagggtttgtgccagaaactaacactaaaaagggaaaagactatcctgttggtccagtcctgctcggtttcttcgtctttgttgtcattggatcatctatctttcagataatcaggacagcaacgagtggaggcatggcataatttgagctatatgctttggactgtgtcgtcatctcttagcgctgtagaaaatggcaatacttttgtactcgttcttgtacttgtactagactcggttcctgttcacgttttgatgaactatgaggatttctaattaaaattactactactacagtattactttt

SEQ ID NO: 370 - DNA, 267 bp, Elaeis guineensis
  misc_feature (133)..(134): n is a, c, g, or t
  misc_feature (152)..(153): n is a, c, g, or t
  misc_feature (168)..(168): n is a, c, g, or t
agaaagaaaaataactcccatatatatctctctcttgagtcgcttctagacattgagaaaagggaaggagggtgccatggggagacctccttgttgcgataaggttggtgtgaagaagggcccttggactccnnaagaggatctcatcctannctcctacatccaagngcatggtccggggaactggagggctgtgcctactaatactgggctgatgagatgcaacaagagctgtaggctgagatggactaattacctgaggccagg

SEQ ID NO: 371 - DNA, 582 bp, Nicotiana tabacum
ggccattacggccggggaatgaataaaaagtcaaaataaattggggcagagaaaaggtggaagaagaaacccttagctgaatttttcgtgttctcatctatcagcggccaccggattttgcttcaactatgacgacatcgaggcgtcttgctgacaggaagattgagaggtttgagaaaaacattaccaagcgaggagctgttcctgaaactaccgcaaaaaagggaaaccagtatcctgttggccctatattgcttggtttctttgtctttgttgtcattggctcatctctgttccagataataaggaccgcaaccagcgggggcatggcttaagcatggaagttaaaagtggtggtgttataggctttgcctgcttgttgtagtagtgtttttctcaaagtttagcccaatgtagaaattgaagagaaacttcaatagaactgtttttaacttgtgagatactcggagaagtataaattttctcctgtctcgtgtgttgatatatttgtgtccattgcgttcttgcagaggtttaaatatcctttcacttctagtataaaccattattataaaatcctta

SEQ ID NO: 372 - DNA, 804 bp, Nicotiana tabacum
gattttagcaagactatccattgaaaacttgaatgagaatagtgctctctccctcctaactcctaagcttgcttcttctctttgttttatatttttttggggtttgaacaaaaaacaagacttgtctggtgggttgatgccaaaggaagaagaaaccacaaggtagattttaccttgaagaaggaaaaactaagaagaagatgataaaaggttttatgaatcaacaaaatcaacctgttgttgtagaggaaaacatgtccaatttaacatctgcatctggtgaagcagcaagtgtatcttcttgcaatagaaatgataataatactaccggaggaatctatccccctcagtataactttgctcctccaaatcaacaaattcaagctcaacatcaaatcaagaaaaagagaaaccaaccaggcaatccagaccctggtgctgaagtgatagctttatcaccaaagacactaatggcaaccaatagatttgtttgtgaaatctgcaacaaaggattccaaagagatcagaatttgcagcttcacagaagaggacacaatttaccatggaaactgaagcagagaacaagcaaagaaataagaaagaaagtttatgtttgtccagagccaagttgtgtacaccacgacccatctcgagcacttggagatctcactggaatcaagaaacacttttgcagaaaacatggtgagaagaagtggaaatgtgagaaatgttcaaagaaatatgcagttcaatctgactggaaagctcactctaaaacttgtggtactaaagagtacagatgtg

SEQ ID NO: 373 - DNA, 939 bp, Nicotiana tabacum
atgcaaaggatatttgtcagataaatctctctgctttaaaagaagctgctatactcagagtcgcaggttttaaagttggcaaatgtgaaatctcgccggaaacttcaccgggaaaacgccaatataagctgctacgttcatatttacagtatttgtttgagaaatgcaagatatacatccgatcggcggcggtggaggacggttttttggtggtggaggagacaggaggttaaggcctaacaatcaccaaaaccagcaagttttaaagtgtccacgttgtgattctccaaacacaaagttctgttactataataactacaatctttctcagccgagacacttctgcaaaagttgccggagatactggactaaaggaggagtcctccgtaacgttcccgtcggtggtggctgccggaaaagcaagcgttcaaaaccaaagcccgctcctccttccgacgctgctgccgaagctgccgacgaggcttcggaggaacataagtcaaactctaattctagcagtgaaagttccagccttactgcaaccacaaccgccgccgcagcagcgaatacctccggtgctgccaccgctgaggttgtgtcggcagcttcttcaaactcagcttcaacttttctcaactttcacgaatccaacttcttcctacctactagtacgaactcaagctttgatcatcagccattaatagatcattctgccgaaggccatattttccaggacattgggaactttacgaacctgatgacgtcgtcgaacgatccatcggtagtagggtttaacatgatggagatgccggcgtaccggttgccggaaaaccagaactcaaatgagcattggaatcaaccggcgaagatggtgggaacagatcagccggttaatgacttgaagatggaacaaatggatactggtttcatgaatcaaac

SEQ ID NO: 374 - DNA, 787 bp, Nicotiana tabacum
gatatgcaaaggatatttgtcagataaatctctctgctttaaaaaaggcagctatactcagagtagcagcttttaaagtcggcaaatgtgaaatctcgccggaaattttaccggaaaaacgccaatataaattgctacattcatttttgacagtatttgtttgagaaatgcaagatatacatccgatcggcgccggtggaggacggttttttggtggtggaggagacaggaggctaaggcctagccatcaccaaaaccagcaagttttgaagtgtccacgttgcgattctccaaacaccaaattctgttactataataactacaatctctctcagccgagacacttctgcaagagttgccggaggtactggactaaaggcggcgtcctccgtaacgtccccgtcggcggtggctgccggaaaagcaagcgttccaagcccaagtccagtactcttccttccaacgctgctgccgaagctgccgacgccgcttcggaggaacgtaagtcaaactctaattctagcagtgaaagttccagccttactgcaaccacacccgccgcggccgcggcgaataccaccggttctgccaccgcggaggttgtgtcggcagcttcttccaactcagcttcaacttttcttaactttcacgaatccaacttcttcctacctaatagtacgaaccaaagctttgatcatcagccattaatggaccattctgccgatggccagattttccaggacattgggaactttacgaactttatgacgtcatctaccgatccttc

SEQ ID NO: 375 - DNA, 907 bp, Hordeum vulgare
  misc_feature (835)..(836): n is a, c, g, or t
cggcacgaggggccggtagggtccaatccagcaggcccagaaaggaaagcttcgggagctttgctcgtcgtgaggggatccttttacaaacccccccgtctttcgcccttgatcccgcatccggcatctcccacttctccggcacttgccccgatcccgcggacgccgtccgctgcctgcatcgtctcaggcgagctcccctgccccgccaagcaaggatgactacttcaaggcgtcttgctgacaggaagagtgcgaagtttcagaagaacatcacaaagaggggctcagtgcctgaaactactgtgaagaaggggaatgactatcctgtcggacctatcgtgcttggattcttcatctttgtggtcataggatcatccttgtttcagattatcaggacggctactagcggtgggatggcttaatatcgagctaaaacaagactattgttatcagagatttattatccatgtgtttgggaggcaatgtcatatctgtactctgtagcaaactttgaccccgatgatgttatgtgagatttaaatcttgtgcggtcgtggttgccttgtgttactaagaaactagtctaaactctaaactagaaaatgaatggtgcataagttgaaactttaaaattatataaacttcaaatatccatggtagcaaaacccgagggggggccccggccccattgcccccttaggaggcggtaacaaatcaccggcccgggttatcaacgcccggccgggaaaacccgagcgccccccacataaacccctgccaaccccaacccccccttgccccaccggggcacccagcgaaaggggcgcccccnncgcccttccaaaagacgcccccccaagaggcggggggaacccgaaagcccaccactgtcaataaaaacccc

SEQ ID NO: 376 - DNA, 528 bp, Hordeum vulgare
gaagaaccctattcgacagatcaggtttagctacccggccgaaatggacatgggcttccacggcgcggcgaacggcactgcttcggcggccgcggggaacggtggcggcggcgcgcatgcgccgccggtgcgcgagcaggacaggctgatgccgatcgcgaacgtgatccgcatcatgcgccgcgtgctgccgccgcacgccaagatctcggacgacgccaaggagacgatccaggagtgcgtgtcggagtacatcagcttcatcacgggggaggccaatgagcggtgccagcgcgagcagcgcaagaccatcaccgccgaggacgtgctctgggccatgagccgcctcggcttcgacgactacgtcgagcccctcagcatctacctccaccgcttccgcgagttcgagggcgaggcacggggcgccggcgtcggccaccatcaccacgggatgccgcccatgatgctcaagccccgcggggcgccggggcccatggtgccgcacggcgacatgcagatgcacgcccg

SEQ ID NO: 377 - DNA, 546 bp, Hordeum vulgare
  misc_feature (322)..(322): n is a, c, g, or t
ccggcccagtccctgcgtccatctgtgctgtgctgtgctgtgctgtgctgtgcctagccagcgccaagaagatacttttcatcaccaacccggccggccaccgtgggagctgaggacgcggcggcggcgccatggggaggcctccgtgctgcgacaaggtgggcgtcaagaaggggccctggacgccggaggaggacctcatgctcgtctcctacatccaggagcacggccccgggaactggcgcgccgtgccgaccaacaccgggctgatgcggtgcagcaagagctgccggcttcggtggaccaactacctccggccggngatcaagcgcggcaacttcaacgaccaggaggagaagctcatcgtccacctccaggcgctcctcggcaaccgttgggcggcgatagcgtcctacttgcccgagaggacggataacgacatcaagaactactggaacacccacctcaagaagaagctcaagaagatgcaggacgccggtgggggtgggcacgacggcggctcggagggcgccggcgtcaccaagg

SEQ ID NO: 378 - DNA, 430 bp, Hordeum vulgare
gaaggccgtcgactccttcggccagaggacctccatctaccgtggcgtcacgcggcaccgttggacgggaaggtatgaggcgcatctgtgggacaacagctgccggcgtgaaggccagagccgcaagggccggcaagtgtacctcggtggctatgataaggaggagaaggcggcaagggcgtacgatcttgccgcgttgaagtactgggggtctagcaccaccaccaacttcccggttgccgactatgaaaaggaggtggaggagatgaagcacatgacacgccaggagtttgtagcttcacttaggaggaagagtagtggattctcccgtggcgcttccatatacaggggtgtcacaagacatcaccagcatggtcgatggcaggcgaggatcggacgggttgccggcaacaaggacctatacctcgga

SEQ ID NO: 379 - DNA, 622 bp, Hordeum vulgare
  misc_feature (619)..(619): n is a, c, g, or t
tggccatagattctcggacgagcaagatcaaggagcgaacatggaaccgtcttcacaacctcagcctgcaataggtgacgttgctggtggatcacaagtgtatccctcctccgcctgtccgcctgcagcaacagtagccgcagctcccggcgtcgctcctgccggttcacagccagccgcaccatttcctgccaatccagctcagctcaatgctcagaaccagcttatctacgagcaagcgcagcaatgtaaccagcagcttcagcagcagcagcagagtcagctgcagcagttcttggccgagcgactgtcagagatcgagcaggacaccgacttcaagaaccacaccctgccgctcgccaggatcaagaagatcatgagggccgacgaggacgtccgmatgatctcggccgaagccccggtggtgttcgccaaggcgtgcgaratattcatcctgrasctgacratraggtcgtggatgcacaccgaggagaacaagcgccggaccttgcaaaraacracytsgccgytgcyatcacmagraccgmygttacgattctggkggacatatttcmyatgwtgasacarggargargggcwtcggcttcccagggtcggncag

SEQ ID NO: 380 - DNA, 667 bp, Prunus persica
agagaaataggggcgagagtttgaacttgcaactcgccttggctgagagaattgtgagaaggaaggggaaaagcctgcaaggaaaagtaatcacctgcgacgctctcaactaccggatcggatctacccgtaaccatgacgacttcaaggcgtttggctgataggaaggtggagaagtttgagaagaacataacaaagagaggggcggttcctgagacaaccgccaagaagggcaaggattatcctgttggccctattctccttggattcttcgtctttgttgtcattggctcatcgctgtttcagataatcaggactgctacaagcggaggcatggcctaattgaagattagcctgctgctgatgcttctaagttgtgagagatggcatcagactgcatcaaccaatcagtcgtgttatttaccgttgttttgttagccagtaggaaactgatgatatacaatgtgatgtagtactaaaacaagtggtgtttctatcctgtgaagttaaaagaagtttgaataaaggaaccccttcctctgcttcacttattttttgttttttgtttttaatttttgcattacacataacttatccgagctacacaatttacctccaattgggcagtttaggcattcttatgtctgatggtttgaggtttgtcgat

SEQ ID NO: 381 - DNA, 566 bp, Thellungiella halophila
gatttataccctcaaaacgatcttgtctacacaatcggtgtaagtgattatagaagagattggttttttgcacatgtcaccagaaacgtaggaaacaatacataccaagcgacaacatggcaaatcatatttaacctcaaaaacgtgaaccgtgtcagactctacacactccgaatagctctagcctcagctgctgattccgaattacaagttcgtattaacaatccaaaatccgatcatattttcacgaccggatatatcggaaaagacaatgcgattgcgagacatgggattcatgggttatatagactgtatagtatcgatgttggtggaaatttactaagtgttggtgataatacgatatatttaactcaaacgagaagtctaggaccgtttcaaggtgttatgtatgattatattcgtcttgaaggtccttccagaacttgattaaagaaaaaaaaaatcaggtagagtgaaaagaaaatttactgtagagggaaatttatatttgttttgttttttattttctagctagaagaattggtgtttattcattcgaatgtaat

SEQ ID NO: 382 - DNA, 323 bp, Thellungiella halophila
ctgtggtcatataccttgccattgtcttagcaggccacattgttgtttcgatagctgacagtttctctccccgtgaaatatcaacacggcttaaaatttcaaaagcaaaagccatatttactcaggatgtgatctttcgtggtgataaaagtattccgctctatagaagagtggttgatgctgaagcaccgatggcaattgttatcccagcgagaggctctagcatcagaatgaacctgcgcgagaatgatttgtcttggaacgactttctggggaaggcaagaaatttgagaggcgtggaatatattgctgtagagaaacca

SEQ ID NO: 383 - DNA, 481 bp, Thellungiella halophila
cgcgtctccgtcactgtcaccgtcgccgtttcttttctcgccctcttcatctctctagtcaccgtttctgctgacgtcatcaaactgccttctcaagcttctaaattcttccgtacgactaaacacaacgatgatggtgattcttcggccggtacgaagtgggctgttctcgtcgccggatctagcggatattggaattataggcatcaggcagatgtttgtcatgcttatcagcttttgaggaaaggtggactgaaagaggagaatatcatagtttttatgtacgatgatattgcaaaaaacaaagagaacccaaggcctggaatcattattaacagtcctaatggaaatgatgtctataatggagttcccaaggattacactggagatgatgttaacgttgataatttgtttgctgtgatccttgcaaacaaaacggctcttaaaggtggaagtggaaaggttgtagatagtggtccag

SEQ ID NO: 384 - DNA, 380 bp, Thellungiella halophila
atattctatgctctcttcctgacctcactcgaactcctcctaacacgccacgtgtcgttcgcagccggaggaaagtggaatctcctcctccccaacgtaggaatctccgcgatgcacatgcagctcctccgcaacgaccgtgtagtaatgttcgaccgaaccaatttcggcccatcgaacatctctctccctaacggtaactgccgcaacaacccaaacgacgcagtttccaaaatcgactgcacagctcactccatagaatacgacgtcgcatcaaacaccgtccgtcccttaaccgtacaatccaacacatggtgctcctccggttcggttagaccggatggtgttctcgtccaaaccggtggagaccgggacggaga

SEQ ID NO: 385 - DNA, 602 bp, Thellungiella halophila
gttttcttctgaaactataacttgatttcgtgcagtattttaagaacttttttatatggattatctgtagattattattctcttccacacaaagaagaaggtctaaagatgtcgtcatcatcatcatataacacaagcgttgttccttcatcatcatcctctgctcagcctttctttatcaccggctccggcgccggagataacgactttgacaggaaagacacttttatgtcaatgattcaacaacctatctcctcagctccaccagccaagaaacgaagaaaccaacccggaaacccaaatcctgatgcggaagtggtggcgttatctccaaaaacactaatggctacaaacagattcgtatgcgatgtctgcaacaaagggtttcaaagagaacagaatctacagcttcaccgtagaggacacaatctcccatggaagctcaaacagaagtcaaccaaagaagtgaagaggaaagtgtatctttgtccggagcctacgtgcgttcaccatgacccgtcacgtgctctcggagacctcaccggaatcaagaagcattactaccgtaaacacggtgaaaagaagtggaaatgcgataaatg

SEQ ID NO: 386 - DNA, 468 bp, Thellungiella halophila
tttcgttctttttttggtttttgtctgaagcttgatctttcttcttcttcttcttctcctctattctttttttttttgtaagctcttgaaattaaccagagacaatggaaacgaaatggctatttacctcggctttctctcaaatgttcggctactcaaaccgtatggatcaaaccagcaactgccaaaacacccgcaacaaaataatgatgatgaagaaagaagaattcccaagtggattccaagttcctcttcactaccctaaatactccaagtctgattatgaggccatggatgatctcagccttgacttgctcctcaaacagtatggattgtccttcgaaggatctcttgatgacaagcgggtctttgcaattgaatcatttctctggcccgatcagctttagggtttatgttggcatctgaattctctcattatctctcttaaccaatagattcagtgaccct

SEQ ID NO: 387 - DNA, 467 bp, Fragaria x ananassa
gcacgaggagaagaagaaccgaagggccctaatcagctgcgacgcgcactctttctcctccgcaacctgaacagcaatgacgacttcgaggcgactcgcggataggaaggtggagaggttcgagaagaacatcaccaagagaggagcggtgccggagacgaccgccaagaaggggaaggattaccccgtcggacctattctcctcggcttcttcatctttgttgtaatcggatcatctctgtttcagatcatcaggacagctacgactggaggcatggactaaattgagtctaagttatgagagagagagattgaatcatcgtcctgtcagtgtggttttacttattcttatagttagccagtagaaaaaaacaactgatatacaagactgtgatctactactacaagctgtggttactatcttgtgaaggaaagaaaaaaacttctatgtagacgttgtcaagttt

SEQ ID NO: 388 - DNA, 808 bp, Brassica napus
tcgatccgattcaaggaacgagatgattaaacgtcgtcgtccgagaacttttggaaaacgaagtgggcggtgaagaggattgtgatggttatgatggctggttttggaagcggttttgtttactatgggattcaactaaacgctgagaatctcaacttcaatctctacttgaccgtcgcggtgaacgctatgatggagtttcctgcggttttcatcggaagcttcctcctcggagtgatgaaccgtcgtccgctgttctcaaactcatcttacctagctggaatctcgtgcttgctctgcgcggttctctcgctccagcgtgtgaccaaggccatgcctgtagccaaatggctgcagcttgcrgttgaggcggttggkttcatggcgtcctcgacsgcktaygaygttctatatgtctatgcggtsgagctgttcccgacraacgtgaggaactttgcggtttcgcttctkcgtcaagcgtttatgytkggagcgtctgcggctccgttgctagttgcgttgggaagggagagtgcgatgatgtcgtttattgtgttcggcgttgcgtctgtgttgagcggygtggtkagcctstggctaagagaracgcgwaacgctccgttgtatgaaacgctaaggyagcaggagaaagcagaagagatggaraacagaacagaacacacttgatcaytttagtgctggtcttatatgatgtttttatgtctaataaatgggaaaaatgtaaaatcttttcgatttaccagcgcattgtaatgcaacgttgatgaaatgttagtctaaattaatc

SEQ ID NO: 389 - DNA, 668 bp, Brassica napus
taccactcatgggttacttggagagaaagtcatggagaaacctttacagaatcacatcccttcttcctcttggatacgctgtttttctcttgccctttgcttatgagtcccctcgatggcttctcgtcaaaggacgtaacaaagaagccatggtagtcttgaagaaactcgcgaggcgcaatgggaaacaacttccagctgatctaagcctagtcgatccgattcaaggaagagatgatccatctttctcgtcatctgagaacttttggaggactaaatgggcagtaaagaggatcgtaatggtgatgatggctggatttggcactggttttgtttattatggaatccaactaaacgctgagaatctcaacttcaatctttacttaactgttgcggtgaacgctctgatggagtttccagcggttttcatcggaagtttcctccttggcgtcatgaaccgtcgtccgttgttctccaactcatcatacctagctggaatctgttgcttactctgtgcggttctctcgctccaccgtgtgacccgtgcactacctgtttccaaatggctgcagctagcagttgaggcaatcggattcatggcgtcctcaacggcctacgatgtcctatattgtctatggcgtcgagctgttcccgacaaacgtgaggaa

SEQ ID NO: 390 - DNA, 792 bp, Brassica napus
ggacggcgcgtgagattagaacgtacggccctcggctcgggaggagcagagccgagtacatcaacgctggtctatacctgttcgcaaccgtggtgctcatcggcggattcacagccaccggtttctcgtgggagccaagatccggcctcgtccttattctcttggctcttgctcttataactgccgtgaatgttcacgatctsgtagctcatttagccggaattgattaccgtttaaagttratggagtatgatttgcaactggggctagtggaatttgccgtccctctggttcagatagctggttcggtcgtcttcttcttgggyatccttttcgttttcaatcaggcrgagacaaaacatggraatagtggaagagagaagcacgcwttaaacatgcttattgcgggtcctttgctttgggtgataggatcgattcacaactcgtgccaaatctatgaaagagctgacagtcacgtccagatactacagcagtgtgtkcacatccctttcttggttggatcccttctcttcttggtttcctcacttctcaatagctttgatcarwccgggtcatctcacactgccttgaagcttcttgggaggagatggatttggctkggkctttccgggtcaatatgtctgtttgtkggaggactgatgaacgttgttaaggtttttaactttgttcaratcactgggctccgcctcgagaaactkagrggtggagcacaagaccggcttcttgaggagagggaagggtatctccctcttgttgccgaaaaaaaaaaag

SEQ ID NO: 391 - DNA, 1214 bp, Brassica napus
ggagattgggggaaactaataaatgttataaagaacccatctctcattctcgaattattgtttttggttactgatagagagagaaacatatatatagagaaatataaatactcctaagaaattagaagagaaatatggttaaatcgagagatatgttgccgtccttggcgatggtgttagtgcaaattggctacgcaggcatgaacattacgtcgaagatggctatggaggccggcatgaagcctctcatccttgtcgcttatcgccaaatmtttgcctctatcgccactttaccggttgcatttttccttgaacgtaagacaataccgaaaatcacaatgagggttcttgtccaagccttcttctgctctatcactggtgtgacaggaaatcaagtgctctacttcataggacttcagaattcatctccgaccatcgcttgcgccttaactaatctcttaccggcggtcactttcctcctcgccgcaatcttcagacaggaatctgtagggattagaaaggtatcaggacaagccaaagtgatagggacagtagtatgtgtcgccggggcaatgcttctctccttctaccatggccacaccattggcattggagagtccaagatccattggacctatgctcaaaacatcacggcccatggttccgattctgccggttctaacttcttcttaggacctttcctaatcatggctgctgccgtttcttgtgccggttggttcattattcagacgaaaatgagtgaaacatttgcagcaccatacacgagcacacttctaatgtgtttgatgggaagtatccaatgtggagttgtcgctttaatctccgatcacaaactagctgattggtctctcagctctcctctccgcctcatytccgycctttacgccggagtggtggcgtctgcgttagcgtctgcttaatgtcatgggcgataaatataaaaggtcctctctacgtctctgttttcagccctttagtgcttgtaatcgtcgccgttttcagctggactcttcttgaagagaaactctacaccggcacgtttatgggatcagcacttgtggttattgggctatatggtgttttgtggggcaaagatagagagatgaatgagaaggaagacgaagtagagatccaaaagatggcgaaacaacaaccaacagtcaaagggatataaatgaagatattgagtcgga

SEQ ID NO: 392 - DNA, 984 bp, Brassica napus
gacacaaaataacacacagagagacaaagagagaattggttttcagatcgaaaatggggaaragaagaggmgtctccgcagtgaacgtggttttcgggtggctgagaaagcaatcgaagaaggttaagatagctttaggggtcatcctctctctgctcctcgtcgtgtttcttaaattcaccgttaagaattacaatcacttctttatcgcctccgagctcatccatgcagccggaatcataatcctcatctacaaactcacccgacaaaagacttgctccggtctttctttaaagtctcaagaagtgacagcagtgtttcttgcggtgagactgatctgcagcataaacatggaaggtgatatccatacagttctcgatttcgccactttggtttcgacgctgtgggtcatttatatgattcggttcacgctgaaagcatcttatataaagactcttgacacctgccacaattactatgtgcttgttccatctgctattcttgcgttgattatccacccgaaaacgagttataactacatacacagtgtcatgtgggctttttgcgtttactctgaatctgtctctgttctgcctcagcttcgattaatgcagaatgcccaaatcatagagcctttcacagctcattacgtgtttgcactgggaatcgctagattcttagcatgcgctcattggcttatccaggtctttgagacgcgtggacgttacctatggctgatcggcgctggttacttttggttcccggtggctctagtagccgagctcattcaaaccttcatccttgccgacttctgctactactatgtgaaaagtgttatggagggtcagctcgtactgaagatgccggtttagatcggcacagatgaatacattttaatggtaaaaacaatctagacatgtttctttctgccttttcctgctttcttgtctaagaatgattagaaaagttwaaggagtatcaata

SEQ ID NO: 393 - DNA, 1040 bp, Brassica napus
ggagagacagagagagatttggttatcagatcaaaccaaaaatggggaagagaagaggcgtctccgcagtgaacgttgtattcgggtggttgagacaccaatcgaaaatggttaagatacctttagggatcatcctctctctgatcctcgtcgtgtttcttagattcaccgtcaagaatcacaaccacttctttgttgcctctgagctcatccatgccgccggaatcataatcctcatctataaactcacccgtcaaaagacttgctccggtctttctttaaagtctcaagaagtgacagcagtgtttcttgctgtgaggctgatctgcagtataagcatggaaggtgatatccatacagttctggatttcgccactttggtttcgactttgtgggtcatttatatgattcgattcaaactgaaagcatcttatgtgaagactctggacaactgccaccattactatgtgcttgttccatctgctatccttgctttcattatccacccgagtacgagatatacttacatcaaccgtgtcatgtgggcgttttgcgtttacttggaatctgtctctgttctgcctcagcttcgattaatgcagaatgctcaaatcatagagcctttcacagctcattacgtgtttgcgctaggtatcgctagatttttagcatgcgctcattggcttatccaggtctttgagtctcgtggacgttacctatggctaatcggcgctggttacttctggttcccgatggctctattagccgaggccgttcaaaccttcatccttgccgacttctgctattactatgtcaaaagtgctatggagggtcagctcgtactgaagatgcccgtttagatcaatatagatgaaaaccgatacattttgttgttttcgacattttaagctacctgtaaccaaaagtagatgctcaaaataatctagacaggttttttttcttcagtttcctgctttttgtttcagaatatttagagaagtttggtatcaaaaaatagccaagaatggtctttctcacag

SEQ ID NO: 394 - DNA, 981 bp, Brassica napus
gacacaaaataacacacagagagacaaagagagaattggttttcagatcgaaaatgggaaaaagaagaggagtctccgcagtgaacgtggttttcgggtggctgagaaagcaatcgaagaaggttaagatagctttaggggtcatcctctctctgctcctcgtcgtgtttcttaaattcaccgttaagaattacaatcacttctttatcgcctccgagctcatccatgcagccggaatcataatcctcatctacaaactcacccgacaaaagacttgctccggtctttctttaaagtctcaagaagtgacagcagtgtttcttgcggtgagactgatctgcagcataaacatggaaggtgatatccatacagttctcgatttcgccacgttggtttcgacgctatgggtcatttatatgattcggttcacgctgaaagcatcttatataaagagtcttgacacctgccacaattactatgtgcttgttccatctgctattcttgcgttgattatccacccgaaaacgagttataactacatacacagtgtcatgtgggctttttgcgtttactctgaatcagtctctgttctgcctcagcttcgattaatgcaaaatgcccaaatcatagagcctttcacagctcattacgtgtttgcactgggaatcgctagattcttagcatgcgctcattggcttatccaggtctttgagacgcgtggacgttacctatggctgatcggcgctggttacttttggttcccggtggctctagtagccgagctcattcaaaccttcatccttgccgacttctgctactactatgtcaaaagtgttatggagggtcagctcgtactgaagatgccggtttagatcggcacagatgaatacattttaatggtaaaaacaatctagacatgtttctttctgcctgttcctgctttcttgtctaagaatgattagaaaagttaaggaggtacca

SEQ ID NO: 395 - DNA, 819 bp, Brassica napus
actcgatttcgccactttggtttcgacgctgtgggtcatttatatgattcggttcacgctgaaagcatcttatataaagactcttgacaccggccacaattaccatgtgcttgttccatctgctattcttgcgttgattatccacccgaaaatgagttataactacatacacagtgtcatgtgggccttttgcgtttacgctgaatctgtctctgttctgcctcagcttcgattaatgcagaatgcccaaatcatagagcctttcacagctcattacgtgtttgcactgggaatcgctagattcttagcgtgcgctcattggcttatccaggtctttgagacgcgtggacgatacctatggctgatcggcgctggttacttttggttcccggtggctctagtagccgagctcattcaaaccttcatccttgccgacttctgctactactatgtgaaaagtgttatggagggtcagctcgtacctgcccgggcggccgctcgactgacgggtctaagctcggtctcatgggtcctaaactacctccgtgggacgagtgatacggttccggagcaattggactatgctaagcgccgtatggctgacgcagtaggctatgctggccagaagggaaaagagatgggtcagtatgtgcaggataaggcccatgaagcacatgatactagtcttaccactgagaccactgagccaggtaagacaaggaggcacacataaaactgcgggcttttgttggaaaggcgatatgtattttactttcgtgtcccagtttcttccttctagaatcttctgtcaacatgtct

SEQ ID NO: 396 - DNA, 855 bp, Brassica napus
gaaatacggacatgcgctgaacacaacaaacgattctttttaagagaatctctctctctattctctccacttctctctctggatcgatggcagcttcggttgatcctttggtggttggaagagtgatcggagatgtgttggacatgttcatccccaccgccaacatgtctgtctactttggccccaaacacataactaacggctgtgagatcaaaccctccgccgcagtcaaccctccaaaagtcagcatctccggcaactccaatgagctttacactctcgtgatgactgacccggacgcacctagcccgagcgagccgaatatgagagaatgggtccactggattgtcgtagatatcccgggaggcaccaacccctcgaaaggaaaggagatactgccatatatggagccgagaccaccggtggggattcaccgttacatatttgtacttttcaggcagaactcaccggtaggtatgatggtgcagcagccgccttcgcgagccaacttcagcacccgaatgttcgctggacatcttgatcttggtttgcctgtggccacagtttacttcaacgcccagaaagagccagcttcacgcagacgctgatgcatgtcaaccaaaataaaagagagagccttttccggttttaccgaaaaaccggaccggaaagaaatatggggtttatatatcaaaccatattttgtatcatccggttctcgactatatatatgtgtagatgcatatacaattatacaaatatgtttatgttgtgtgttatattaagtggcttgcgtataatatatggttttcgttttcttttatctttaaataaactaaaaaataatagtatgta

SEQ ID NO: 397 - DNA, 800 bp, Brassica napus
gaggacatgcgctcaacgattcttcttctataactaaaagaatctctaattctctctttctctatctctacttctctctttctctttccgtggatcgatggcagcagcttcggttgatcctttggtggttggaagagtgattggagatgtgttggacatgtacatccccactgccaacatgtcagtctacgttggccccaaacacatcactaacggctgcgagatcaaaccctccgtcgcagtcaactctcccaaagtcaacatctccggcaactctgatgagctttacaccctcgtgatgactgacccggacgcacctagcccgagcgagccgaacatgcgagaatgggtccattggattgtcgtggatatccccggaggcaccaatccatcaaaaggaaaggagatactgccatatatggaaccgaaaccaccggtggggattcaccgttacatatttgtacttttccggcagatctcaccagtgggtctgatggtgcagcagccgccgtcacgagccaatttcagcacccgaatgttcgctggtcatctcgatcttggtttacctgtggcaactgtttacttcaatgcccagaaagagccagcttcacgcagacgttaattccaataaatagactaaagaataacgacgagagccttttcagggtttttacccaaaaaccggactggaaagaaatgtggtttttatatgtcaaaccatatttaatattattccggttctcgctacatatctatatatgtctataattatacaaatatgtttgtgttttggtgttaca

SEQ ID NO: 398 - DNA, 738 bp, Brassica napus
gaacaccaaaattatctgtatttcccatttccaaacagagtccctttttaactaaaaaaaataaaaatcactatggcccatatcctcaacacccaacatctcctcacaacctccgggaaaaaacgaaacgaccgcgatgacgaagacggagtctccaccgttgcaaagaaatcttcacttatggcatgtgaagctgaccccgctgtggcgctggcaagcatccgacacgaattcggggagcacggcggagtgaacatgtccatcgaggcctccgccacctttacggtcatggaaccggacaccatgaggcggatgttcgccggagaacttggaccggaaaatgacttcttcgtatatagccgacacttcaaccccaccgtgctcaacctcagccgtcagatggctgctctcgaaggcacccaagccgcctattgtacctcaagcggtatggcggcgatttcgtcggtgctgctgcaactatgcagcagtgggggacacgtggtggcttcaaagacgctctacggaggaacacacgctttgctctctcatttcttgccacggacctgcaacataaccacgtccttcgtggacataacggaccatggcgcggtggcagacgcgatcgtcgagggtagaacacaagtcctctattttgagtcgatggccaacccgacgttgactgtggccgacacacctgagttgagccgtatagcacacgagaagggcgtggcggtggtg

SEQ ID NO: 399 - DNA, 584 bp, Brassica napus
gatggtttaggtggtggtggcgaagaaacacgggagagtagcggtacaccgtatattgattacaaattataaggtaaaaacaaaaaaaaaagtttgaagcattgttgttcggctcacacgatctgtcaatttcgattccttgtttcctccgtccacgaagagtgtttctacaatgacaacttcaaagaggctcgcagacaggaagattgagaagtttgacaagaacattactaaaagaggytttgttcccgagaccaccacmaagaagggyaaagattaccccgttggacccatcctcctcggcttctttgtcttcgtcgtcattggctcstctctcttccagatcatcagractgcaactagtggaggcatggcataaraacctaatcatcattcaagctagargaatccattctcaatatgataatctctcctctctttttcccttcyttrtactacttgtagaatgtgtcaactttgtatttactgcaagttaatgtyatcaagaatatcttctttatgttttgctttagttcacttggtacgccacacgtggttgatactgaatacaaaaagggattaac

SEQ ID NO: 400 - DNA, 572 bp, Brassica napus
gaagacatataatagtaataaatatattagtagttgggaaaacaaaaacaaaacaaaaaagtgtttttttttctctcttcagctcgatcgagatcacagcgttttcttctccggcgtaatcatgacaacttcaaagagactggcggacaggaagatagagaagtttgacaagaacattactaaaagaggttttgttcctgagaccaccaccaagaagggcaaggactaccctgtcggacccatcctcctcggtttctttgtcttcgttgtcattggctcttctctcttccagatcatcaggactgcgaccagcggaggcatggcataaaccgaatcaccattcaagctaagaggaagcagttttcattatgaatttctcttcttctgtcttgtctctttttccctttgtactgtacaatgtgtcaactttctgtttttctgttttaccacagtactaatgttatgcagaacagaatgttttctttaaagttattatatatccaacgttaaatgttttcttaaggaaaaaaaacaaccacaacgaaaaatttttcttttttgcccccttgggc

SEQ ID NO: 401 - DNA, 496 bp, Brassica napus
ggaaaaaaaaaaggaaaattaaaaggaaacgcggaaagtttttcttctgctcgcgagattgtcaattcgattccttgtttttatttttcatctccggcgtaatcatgacaacttcaaagaggctcgcagacaggaagattgagaagtttgacaagaacattactaaaagaggttttgttcctgagaccgccaccaagaagggcaaggattaccctgttggacccattctcctcggcttctttgtcttcgtcgtcattggttcatctctcttccagatcatcaggaccgcaactagcggaggcatggcataaatcgaatcacagttcaagctagaggaaacgcctttttcaaagttgaatctcttcttcttcttcttcttcttcttctgtcttgactgtttttccattatactgtagaatgcgttaactttctgtttactttacatgttataaagaattttgagaatctttttctataaaaatcttgtcttgaagtt

SEQ ID NO: 402 - DNA, 527 bp, Brassica napus
tactgtccgacgccgggtggcattgcagcttctgtttcagacgtctcggcgagttcgttttcgagatgaaagggtatagccacgcggatagagtgaagcgcaaggagtttttggactactccaggatacagaaacacatatgtaaaggatatgatctctttgacatgcttcctgaggaatacagcttcaaagatttgattagcaaaatcggacccatcccgccttctgcatccgctgtacatctgcctgcgtttttgattcagaatgctgcccgctttcggtttctcctaccaggaggctgtctcagagagccttagctaaagtgaggatcttagtacagatagagaagcaatggttttttgttaaaaaatatatcgttattacatcatgttaatgtgtttccattcatgtttaccgggtcgacgacatcaaactatttctcggcaccaccatcatcagtcccactcttgtaccaatttatttcgacttagggacaagcaaaactgaatttaaagcaatcaccttat

SEQ ID NO: 403 - DNA, 1109 bp, Brassica napus
ctatctccccagttgcatcagttttgtctgagagagcaccacttttgtgtcratctttagcgatgtcgattcctcaggccaagatggagcttcgtcctctgggaaacacaggyctcaaagttagctcmrtyggcttyggcgcctctccsctcggaagcgtcttcggtccagtcgccgaagtygatgcmgtcgccaccgtacgcgaggcgttccgacaaggcattaacttcttcgacacttccccgtattatggaggaacactgtcggagaagatgcttggcaagggactaaaagcactacaagtccctagaagcgactacattgttgcaaccaagtgtggacgttacgaggaaggctttgacttcagcgcygagagagtaacaaagagcatcgacgagagcttggagaggcttcagctagactacgttgacatacttcattgccacgacattgagttcgggtctcttgaccagattgtgagtgaaacratccctgckctccagaaactgaaacrkgaagggaagacacggttcatcggtatcactggtctyccgttggrtattttcacttaygttcttgatcgagtgcctccagggacggtcgatgtgatactatcgtactgccattacggtgtgaatgattcgacgttggtggatttgataccttacttgaaagggaaaggtgtgggtgtgattagtgcttctccgttagcaatgggtcttcttacggaacaaggtggtcctgaatggcatcctgcttcccctgagctcaagtctgcttgcaaagccgctgctgctcattgtaaatcaaagggtaagaagatcacaaagttggcgttgcagtacagtttggcaaacaaggagatttcatcagtgttggttggaatgagctctgtctcacaggtagaagaaaatgttgcagcagttagagagcttgaagatttgggtatggatcaagaaactctctctgaggttgaagctattctcgagcctgtcaagaatcagacatggccaagtggagtcgatcagaagtagaagctcttttgctgtgtttgttcacatttacttcttggaatgctttgatgtgtcgtcggtaagagattttaggtt

SEQ ID NO: 404 - DNA, 693 bp, Brassica napus
tagcaactatgacttacgacgcacgtctctggaacctcaaaatgtacgtgaaacactactcacgatgtgcttctgttaaagagatcgttgtgatatggaacaaaggaccgcctcctgaggtgaccgagctagactccgccgtgccggttaggatccgagtcgagaaaaggaactctctcaacaacaggttcagtatcgacccgttgattacaaccagagccgttctggagctcgacgatgatataatgacgtcttgcgatgagatcgaaaaggggtttaaggtctggcgcgagcatccggagagactggtgggatactacccgcgttacgttgaccagagcatgacttatagcgcggagaaattcgcgaggagtcataaagggtacaatatgattttaaccggagcggcgtttatggacgttggtttcgcgtttgggttgtaccagtcggagagggcgaggcttggtcgggagttcgtggacgagcagtttaactgcgaagacgttctgttgaacttcttgtacgcgaacgcgagtggttcggcgaaggcggtggagtatgtgaggccgtctgctttggttcttgatacttcgaagttttcgggcgtggcgataagtgggaacacggatcagcattacaggaagagaagcgagtgtgtgcggagattctcggagttgtacgggagcttgtctg

SEQ ID NO: 405 - DNA, 614 bp, Brassica napus
gtacgagttgatgctgtgatacaagaagcggagaaggttaagggaagagatagcctttatattggaaacattaacttctaccataagcctctgcgcactggtaaatgggctgtgacatatgaggaatggcctgaagagtcttatcctccatatgcaaatggtccgggttacatcttgtcatacgacatagctaagttcatcgtcgatgattttgaacagcagagattaagattattcaagatggaagatgtgagcatgggaatgtgggtggagaagttcaacgagactagaccagtggcagttgttcacagcctcaagttctgccagttcggatgcattgaagactacttcacagctcattatcagtcgcctcgccagatgatttgcatgtgggataagctgcagagactcgggaagccacattgctgcaacctgagatgacttaacattgtgttttcttttggcctgattctggattttttttgcgttagaaaggaaaatgaagaagcagatggggggatttcgtggagctaactgttttagatctctgttgtatagaacaaactataatttatcttatatataatattatgtaatgaagggctcttgaaatg

SEQ ID NO: 406 - DNA, 765 bp, Brassica napus
  misc_feature (18)..(18): n is a, c, g, or t
gaaagaatctatttccantcgctcccccttctcctctcacgtgaagttcttatctcctcttttgtttaaaggggttctttcactaaacatatcatacttgtgtcttcagtttcagtgccataacttttgttttcctctccatttcttgcatacgaaaagttcgtcttggtatttgtgatttgtcatctctgattatttcttctctttaaagcgtggaggagacatctttgaccgttcttgaaaacttgaactgaagcaaagatgggtagagcagcgagatggttcaagggcattttcggtatgaagaagagcaaagagaaagagtaccgagtttccggcgacggaggaggagaagccggtgagtctctcatccaccggaaagttctccaagcagacaacctctggctcagaacatacttggcggaaacagacaaagaacagaacaaacacgccattgcggttgctgccgccactgccgcagccgcagacgcagcagttgcagcggctcaagctgccgtcgcggtggtcaggctaacaagtaacgcgaaaaccggaggatattccggtgggaacgtagtttacgggatcacaatggagcggtgggccgctgtgaagattcaaagtgtcttcaagggctatttggcgaggaaagcgttaagagctttgaaaggtctagtgaagctacaagctctagtgagaggatacttagttcgcaaacgcgcagccgaaacgcttcatagcatgcaagctctcatcagagcacaa

SEQ ID NO: 407 - DNA, 703 bp, Brassica napus
ggaactggtttgattagtggctccaaagaggagatcggacgacgttgcgatccgatggcgtaacgaaggaagcgacgatcttccggtcaacaccatgacgcttcttgagttacgttcacaggtttggttaactgcacatgctcttaatgccttggatttggaggaagagtcagcaatcgcgattgatatgccgatgaacgttgagtccgtgatcatttaccttgccattgtcttatcaggccacgtagttgtttctatagctgatagtttctctccccgtgaaatatcaacgcggcttaaaatttcaaaagcaaaagccatatttactcaggatgagatcattcgtggtgataaacgtattcccctttatagaagagtcgttgatgcagaagcacccttggcaattgttattccagcgagaggctcattcgtcagaatgaacctgcgtgagaatgatttgtcttggaacgattttttgggaaaggcaggaaatatgagaggcgtggaatatattgctgtagagaaaccagcaggagcttgcacgaacatccttttctcatcaggaaccaccggtgatccaaaggctatcccatggacgaacatttctcctttgaaatctgctgctgatgcttggtgccatttggatgctcatcagggagatgttgttgcttggccgaccaaccttgggtggatgatgggtccg

SEQ ID NO: 408 - DNA, 757 bp, Brassica napus
gctctttccatttcacggtttcaagttgaaaccaaagactcctcactttctccctacaatagactcctactaccactctttctctctcttgattctcactacaaaaacgttatagttcccatcaccatactcccaaaaatgcaattttcaagaaactcaatccttaggcaactaagcaggaaagaaggttggaggtcggcttctagaaggtggacatccggagatagctcaacggccttcgccgacgacacaagcggtggtgctggcggttactcttcaatggagggtctatatggggtttattctggtgaagatccggcggcgagaaggaaaagagtgatggttgtggtggatgagacttcaaggtctaaacatgctatgatgtgggctttgacgcacttgactaacaaaggagacttgatgactcttcttcatgttgtgtctcctcatgatgaagcttcgccttctttggttcagtcacttggttctctttgcaaagcttgtaaacccgaggtggatgtggaggcgttggtgattcaaggaccaaagttagcaactgtactcagccaagtgaagaaacttgaagtcactgttcttgttttgggtcagaagaaatctgcaccattcatctcctgcttatgtggacccagtagatcagaggagctcgtgaatcgatgtatcaatggtgcagattgtttgacgattggtgtgaggaaacaaagcaacggtgttagtggctacctgattaacacacgat

SEQ ID NO: 409 - DNA, 1560 bp, Brassica napus
cgactggagcacgaggacactgacatggactgaaggattcgcatgcaaggctagtgacaccaagaagcggagaaaatgagaaatctttactttctagtcttatttccgttgagcatcttgattttggttgatgcttctttgcatgtgaagtatcttcctggtcttgaaggtcctcttccttttgagctcgagactgggtatgtgagtgttggtgaatctggagatgttgagctcttttactactttgtgaaatcagagagaaatccagataaagatcctctcatgatttggctaactggtgggcctggatgcagctccatttgtggtttactctttgcaaatggtcctttggcttttaaaggggatgagtataatgggacactgcctcctttagagctaacatctttttcttggacaaaggtggctaacattttatatttggaatctcctgctggttctggatattcttatgccaaaactcggcgtgctgctgagacgagcgacaccaaacaaattcaccaaatcgaccagttccttaggagttggtttgtggaccaccctgagtttatatccaattcattttacgttggtggagattcatattccgggaagattgttccaggagttgtgcaacagatttcacttggaaatgaaaaaggtctcgcaccactcataaatattcagggatatgttcttggaaaccctgcagtacgtacaaacttagaaccaaatcatagagtttcatttgcgcatcggatgggacttatttcagatgagctccatgagtcacttgaaagaaactgtggaggcaaattctttaacgtagatccaagtaatgcaaaatgttcaaatgggcttctagcttatcatcagtgtatctcagagatatacatagagcagattttgttaccaaactgcaaagtagattatgtcttagcagacatatcacaaaccttaccaaatatcagaaccagtcgaagaagagaactcaaggagttttcaagaaatgattcatcatcgttgcctcctccaagctgctttacttataggtattttctgtctgccttttgggcaaatgatgaaaatgtacgcagagctttaggcgtgaagaagggcttcggaaaatggagtcgatgcaacactcaaaacataccatatacatatgatattcacaatgccattccatatcacgttaataatagccgtaaaggcttccgcgctctcatctacagtggtgatcatgatatgatgatacctttctcttcaactgaagcatggatcaaatctctcaactattccattgttgatgactggagaccttggatgatgaatagcaatcaagttgctggatatacaaggacctatgcaaataagatgacatttgcaaccatcaagggaggaggacacaccgctgagtataatccagaccaatgctcacttatgttcaaaagatggattgatggtgaatctctctgaagttcctcactcacttctctctctctctgtcaaaagtttcatgagttgcttttgttttcgtttatggttattaagtcaaaaatt

SEQ ID NO: 410 - DNA, 871 bp, Brassica napus
  misc_feature (45)..(45): n is a, c, g, or t
gatattatatttataaatagcattggccccccggcctcatcccanaagattctaaaccacgtcaccaccaccttcgccgtagaataattcaaaaaacatgactgccgtcttcaccgtcgtttcctttctagccttcttcctctcgctagtcgtcgtttccggtgacgtcatcagactaccttcgcaagcttctaggttcttccgcccaacagaagacgacgtctgcgatgattcttccgccggtactaagtgggccgttctcgtagccgggtctagaggatactggaactacaggcatcaggcggatgtttgtcatgcttatcagctgctgaggaaaggtggagtgaaagaagagaatattgtggtgttcatgtatgatgacatcgcaaagaacaaagagaacccaagacctggaatcattatcaacagtcctaatggagatgatgtttataatggagttcccaaggattacactggagatgatgttaacgttgataatttgtttgctgtaattcttggaaacaaaacagctcttaaaggaggaagtggtaaggttgtagatagtggtccaaacgatcatatcttcatatactatagtgatcatggtggccccggagtgcttgggatgccaacttctccggctctatatgcaaacgatctaaacgatgtactgaagaaaaaacatgcttctggaacatataagagcttggtgttttatctagaggcatgtgaatctggaagcatattcgaaggtcttttaccagaaggtttaaacattacgcgacaacagcagcgaacgcagaggaaagtagtgggggtacttatggtcctggagaggatactagtgtaccgtccgagtttgagactgttt

SEQ ID NO: 411 - DNA, 629 bp, Brassica napus
aagacacatttgttgggtccattcccaacgccagttttaccgcgactgctacatttacggaaccgtagatttcatatttggaaacgcggccgcagtcttccaaaactgtctcatcctcccacgccgcccgctcaagggtcaagccaatgtaataaccgcgcaagctcgtgcacatccgtttcagaacactggaatttccatccataactcaactatcctaccggctcctgatctaataccggtgatgagtatcgttaagacgtacatggggaggccgtggatgaagtactcgcgcaccgtggttctccagacgtatttggatagtgttgtgagtccgttaggttggtcgccgtggcttaaaggttcggatttcggtttagacacattgttctacgctgagtataataataccggaccagcttcgtccacgagcgggcgtgttcgttggaaagggtttcatgtgttgaatagagcttccgatgcatctgctttcactgttggaagcttcatcgccggtaccgcatggctcccaggcaccggcatacccttcaattctggactctaaggctacctatggtttgttgtcttggttatcgtgcttaaagctacaatgatataaaaattctatc

SEQ ID NO: 412 - DNA, 717 bp, Brassica napus
ggactcagtagtaacttcttccttataaatacaaattgtccacaacttctctgagtccacttccaaggraaactcacaaacacacttcatgcctttgaatgtcgcttataaagatattataaagggataatgagaatcagctgtaatgggtgtagagtcctacgcaagggttgcaaccaagattgcaccataagaccatgtcttcaatggatcaaatccgcagactcccaagccaatgccacactcttccttgccaagttctatggtcgagccggtctccttaacctcatcgaatctggtcctgaccatcttcgtcccgcaatatttaggtcacttttgtacgaagcgtgtggacggatcgtgaaccctgtggatggttctgtgggtctgatgtggtctggaaactgggcccagtgccaagcagccgttgatgccattctcaacggcttacccatcactcacacgcctctccccagtgcatcctcgtcgcaccagatcattcctcctcacaggacatacgacatacgccacgtggcgaaagatccaacaacaggaggcgacagttcggagagtctggcccttgccccacgtgttaacggtaacaaggcgaagacacaaactggccggttaaaacgcctagcagagacagtggactaccaactaggtgaatgtagtcacgacacgtggcagatccagtgttctggtgcaacgcatggc

SEQ ID NO: 413 - DNA, 663 bp, Brassica napus
gtccacttccaaggaaaactcacaaacacacttcatgcctttgaatgtcgcttataaagatattataaagggataatgagaatcagctgtaatgggtgtagagtcctacgcaagggttgcaaccaagattgcaccataagaccatgtcttcaatggatcaaatccgcagactcccaagccaatgccacactcttccttgccaagttctatggtcgagccggtctccttaacctcatcgaatctggtcctgaccatcttcgtcccgcaatatttaggtcacttttgtacgaagcgtgtggacggatcgtgaaccctgtggatggttctgtgggtctgatgtggtctggaaactgggcccagtgccaagcagccgttgatgccattctcaacggcttacccatcactcacacgcctctccccagtgcatcctcgtcgcaccagatcattcctcctcacaggacatacgacatacgccacgtggcgaaagatccaacaacaggaggcgacagttcggagagtctggcccttgccccacgtgttaacggtaacaaggcgaagacacaaactggccggttaaaacgcctagcagagacagtggactaccaactaggtgaatgtagtcacgacacgtggcagatccagtgttctggtgcaacgcatggc

SEQ ID NO: 414 - DNA, 636 bp, Brassica napus
gagaagtgttgagagaccacatttgcttagttttgtcggttgtccgagaaagggcttggagaaagcagccattagagacgagctgatcagacaatgcgctgactcgagccgttgtgagcttctcaagtgtgaaagtggagggtccaggtgccacgacccgatgacggtattaggagtgatggctcggtcacggttttgcctacaagcaccaggtgattcgttcacacgtaggtcaacattcgatgcaatgttagccgggtgcataccggtgtttttttcaccacacactatgtatacacaatacatgtggtatcttcctgacgacaaaaggagttactcagtgtttatggacgaaaagaacagtactctaatagaacaagaactctcgaggatctcggagagtgaggtggttcacatgagggaagctgttattgcaatgatcccgaaaatgacttatgcgcacccaaacgctactaactatgatttgccagatgcggttgatgtagcgttagaggcattagctatgcaagcaaagrcmaaggttgtgtactcattgtaataagctcttatgtttttgctcctttttggatgtaattaatcatactcttaatcataatgactcgagaattaccaaat

SEQ ID NO: 415 - DNA, 1886 bp, Brassica napus
tttgtattctcctcgttgtttaaatccagaaacaacacagaagatagaaaaaatgtcgtttacaggaacattggataaatgcaaggcctgtgacaaaaccgtctacgtgatggatttgttgacgttggaaggaaacacttatcacaaaaactgcttcagatgcagccattgcaatggctctctcgtgataagtaactactcatcaatggatggagttctttactgcaagcgtcactttgagcagctttttaaagaatctgtcaagagtcttcacacaggaggaaagacagacaagacgaatgatcagctaactcgagctccaagcaagttatcttcattcttcagtggaacacaagacaagtgtgcgacttgtcagaaaaccgtttatccacttgagaaagtaacaatggaaggagaatgtttccacaagacttgcttcaagtgtgcacacagtggttgtcctttgactcactcttcttacgcttctctcaacggtgtcctctactgtaaagttcatttcaaccagctctttctcgagaaaggaagttacaataacgtccatcaagctgctgctaaccaccgtcgatccgcctcttctggtgcctcttctcctcctcatgacaaccacaaacctgaagatgaggccgtggctcccgagggagaagaaggagaaggaaaagaagaagaagaagaagcagcccctgaagctgcaggagaagagcctgagcctaaggctgagtaactatcctaccagttctcaagtttgaagttttatatgctttttatgtttacaaattaatatatgtatacaatcattctttttgtaaattattgtaaagcttggagagaatctgttgtaaaaacaaacctttaacatccaaaaaaaaaaaaaaaaaaaaaaaaaaaaaaaaaaaaactcgagactacaaacttaactttcaagctcaaacaactttacactatggctttccacttccggcgactttgcatgtcctctgctcttctggtggtagttctccaaatcctgcatggcgtatccggccaacttgttgtggttgaggaccctgtttctgcttctccgccaccattggtcgaacaagacggcagtgatggcattgtgcccgcactgtttgtgtttggtgactctctcatagacaatgggaacaacaataacatcccttcctttgctaaagctaattactttccttatggcatcgatttcaatggaggtcctaccggtaggttctgcaatggcttgaccatggtcgatggtattgcccaactattggggttgccgttgattccggcgtactcggaagctaccggagatcaagtgctacgtggtgtcaactacgcttccgcagcagcggggattcttcctgacaccggaggaaactttgtggggcgaataccgttcgaccagcagattcataactttgagacaacgttaaatcaggtggctagtaagtccggtggtgcagtgacaattgcagactcggtggctcgaagcttgttcttcattggaatgggaagcaacgactatctcaacaattacttgatgcccaacttccctacccgtaaccaatacaacgctcaacaattcggtgacctcttggttcagcaatataccaatcaactcaccagattgtataatctaggtggtaggaaatttatagtgtccggacttggaagaatggggtgcattcctagtattctagctcaaggaagcgacggtgaatgctcggaagaagttaaccaacttgttcttcctttcaacacaaacgtcaagacaatgatcactaatctcaaccagaatcttcctgatgctaaattcatttacctcgataccgctaatatggtccaagacatcaccactaacccaggcc

SEQ ID NO: 416 - DNA, 1464 bp, Brassica napus
gaataaaattaaaccctatcaaactcaaacaccttcacaatatggctttctacttccggcgactatgctactttccagctcttctcttggtggttatccagcttttgcatggcgtctgcggccaactagttgtggttgaggaacctacttatgctcctccgcctccactagttgtgattgaggaacctacttcttctcctccgcctccattagatgtggttaatgaacctatttttgctcctccgcctccattagatgtggttaatgaacctatttctgctcctccgcctccattaaatgtggttgaggaacctctttctgctcctccgcctccattacatgtggtcgaggaacctatttctgctcctccgcctccattagtcaaacaagacggcaatgatgccattgtgccggcattgtttgtctttggtgactctctcatagacaatgggaacaacaataacatcccttcctttgctaaagccaattacttcccttatggcattgatttcaatggcggtccaaccggtcggttctgcaatggcttaaccatggtcgatgggattgctcaactattggggttgccactgattccggcgtactcggaagctatcggagatcaagtgcttcgtggtgtcaactacgcttctgcagccgcagggattcttcctgacaccggaggaaactttatggggcgtataccattcgaccagcagattcataacttccagacaacgttggatcagatggccagcaagtccggtggtccggtggccattgcagactcggtggctcgaggcttgttcttcattggaatgggaagcaacgactatctcaacaactacttgatgcccaatttccctacccgcaaccaattcaacgcccaccaattcggagatctcttggttcagcactacgccaatcatctcaccagactgtataatcttggtggtcggaaatttgtggtggctggacttggaagaatgggatgcattcctagcattctagctcaaggaaccgacggtaaatggtcggaggaagttaaccaacttgttcttcctttcaacacaaacgtcaaaacaatgatctccaatctcaaccagaatctcccggctgctaaattcatttacatcgatatcactcatatgttggaagacatcatcgctaacccggccatttatggagttactactttggacaaaggatgttgtgggataggacggaacagaggacaaatcacatgtcttccctttgagactccttgtcctaacagagatcagtatctgttttgggatgcttttcatcctaccgagaaagtcaatctcgtaatggctaagaaagcgtttgctggtgaccgcacagttgcgtttcctatcaacattcaggaactggctagtctcagttagaggaccatcctttcttatggagtaaaccaagaaaaaattaaaaacttcgtgtggtgtc

SEQ ID NO: 417 - DNA, 2247 bp, Brassica napus
tttgtattctcctcgttgtttaamtccwgaaacaacacagaagatagaaaaaatgtcgtttacaggaacattggataaatgcaaggcctgtgacaaaaccgtctacgtcatggatttgttgacgttggaaggaaacacttatcacaaaaactgcttcagatgcagccattgcaatggctctctcgtgataagtaactactcatcaatggatggagttctttactgcaagcgtcactttgagcagctttttaaagaatctgtcaagagtcttcacacaggaggaaagacagacaagacgaatgatcagctaactcgagctccaagcaagttatcttcattcttcagtggaacacaagacaagtgtgcgacttgtcagaaaaccgtttatccacttgagaaagtaacaatggaaggagaatgtttccacaagacttgcttcaagtgtgcacacagtggttgtcctttgactcactcttcttacgcttctctcaacggtgtcctctactgtaaagttcatttcaaccagctctttctcgagaaaggaagttacaataacgtccatcaagctgctgctaaccaccgtcgatccgcctcttctggtgcctcttctcctcctcatgacaaccacaaacctgaagatgaggccgtggctcccgagggagaagaaggagaaggaaaagaagaagaagaagaagmagcccctgaagctgcaggagaagagcctaaggctgagtaactataccagttctcaagtttgaagttttatatgctttttatstttacaaattaatatatgtatacaatcattctttttgtaaattattgtaaagcttggagagaatctgttgtaaaaacaaacctttaacatccaaaaaaaaaaaaaaaaaaaaaaaaaaaaaaaaaaaaactcgagactacaaacttaactttcaagctcaaacaactttacactatggctttccacttccggcgactttgcatgtcctctgctcttctggtggtagttctccaaatcctgcatggcgtatccggccaacttgttgtggttgaggaccctgtttctgcttctccgccaccattggtcgaacaagacggcagtgatggcattgtgcccgcactgtttgtgtttggtgactctctcatagacaatgggaacaacaataacatcccttcctttgctaaagctaattactttccttatggcatcgatttcaatggaggtcctaccggtaggttctgcaatggcttgaccatggtcgatggtattgcccaactattggggttgccgttgattccggcgtactcggaagctaccggagatcaagtgctacgtggtgtcaactacgcttccgcagcagcggggattcttcctgacaccggaggaaactttgtggggcgaataccgttcgaccagcagattcataactttgagacaacgttagatcaggtggctagtaagtccggtggtgcagtgacaattgcagactcggtggctcgaagcttgttcttcattggaatgggaagcaacgactatctcaacaattacttgatgcccaacttccctacccgtaaccaatacaacgctcaacaattcggtgacctcttggttcagcaatacaccaatcaactcaccagattgtataatctaggtggtaggaaatttatagtgtccggacttggaagaatggggtgcattcctagcattctagctcaaggaascgacggtaaatgctcggaggaagttaaccaacttgttcttcctttcaacacaaacgtcaaaacaatgatctccaatctcaaccagaatctcccggatgctaaattcatttacmtcgatatcactcatatgttggaagacatcatcgctaacccggccatttatggagttactactttggacaaaggatgttgtgggataggacggaacagaggacaaatcacatgtcttccctttgagactccttgtcctaacagagatcagtatctgttttgggatgcttttcatcctaccgagaaagtyaatctcataatggctaagaaagcgtttgctggtgaccgcacagttgcgtttcctatcaacattcaggaactggctagtctcagttagaggacyamctttcttatggagtmaaycaagaarwaatwaaaaacttygtgttgtttcgtgtctttgtcatttgttcttgtaacgttttttcattagttttcgttcatgttaaaaacatttgagtcaaatcatttttactt

SEQ ID NO: 418 - DNA, 470 bp, Brassica napus
aatcatacgctactggctcaacgacacgtcggtttctaaatctcacgagaagtatgagattttcgcggaggggctgcctgggttccccgacaacataaagaggagtccacgtggtggattttgggtaggcctgaatacaaaacactcaaagctgacaaagttcgccatgtcgaatgcctggctaggacgcgccgctttgggcttgccggtggactggatgaaagttcattcgtattgggctaagtataaagggaacgggatggccgtgaggttgagcgaaggtagtggcgtaatatcggaggttttcgagggtacaattggaaataagtggatctctataagtgaggtggaggagcgtgatggaactctatgggttggatcggtgaatactccctacactggagtgtataaaatctaaacaaatcttcgattgttattcatacaacatataaggatactttctcatttca

SEQ ID NO: 419 - DNA, 774 bp, Brassica napus
gacttggtcgacgtcaaactcggacgctactatgaactcgtcgtcacaaccttcgcaggattgtaccgttacagaatcggcgatgtccttcaagtggcggggttctacaacaaagcaccacagttcaggtttatctgcaggagaaacgtggttctaagcatcgacttagacaaaaccaacgaggaagatcttcacaggagcatcacgctggccaagaagaagcttgaaaacaaggcattcctcgcggagtacacgagctacgcggatacttcatcagtgccaggtcactacgtgcttttctgggagatccaatggcttgaacctgatgatgaggaggagaagctgctgatggaagagtgttgcattgcggttgaggaagagctggattacatatacaggcaatgcaggaagagagatagatcggtggggcctttagagataagagtggtgaagccagggacgttcgagaagctgatggatatgataataagccaaggagggtcgcttaatcagtacaaaacgccgagatgtgttaagtccaacagtgctatgctcaagctcttggacggccacgcgaccggttccttctctagccctcgtgatccaacctggtccccttgatgtcgaacgtatgtattgatcggagagactataagttactaatcagtattcggtaataaccaaatgggatcggatttgctgtaggctagcagtagcaggcatgtaatgctactacctgattgattaaaaatgttatagaaacttcatttaccg

SEQ ID NO: 420 - DNA, 305 bp, Brassica napus
gagaggtttgtgagagaagagagttcaaagagcttgaaggatttgtctggacagatatgttcagctcatcaaatgggaagttgtaggatggggataagacccgaagaatctgcggtgaggccaacgggagagacttgggaggtcgaaggcctatttgtggcggatacaagtgtttttccgacggctttaggggttaatccgatggtcaccgttcagtcaattgcttattgtattggacttaatgttgttggggctcttaaaaagaagtgaagtctcgtttatactagacttaagtttttcatatt

SEQ ID NO: 421 - DNA, 621 bp, Brassica napus
ggatgcatgtaccactctcatgagagccttcaattttccttggaaaaaagtatttcaaatttgaaagacatgaggttgtctttcactatacaatcattagcatttgttccattgtttgtagtagtggtacatgcagtagtcatcgcagccgaagatggaaactcgccggaggaagcaatgtttccagcgatgtttgtgtttggagactcattggtggacaacggaaacaacaaccgcttgaattcgctcgctaggtccaactatctcccatatggcatcgattttgacggcggtcaacccaccggtcgattctctaacggcaaaactatcgtcgatttcatcggagagttgctggggctgccggatataccagcgtttatggaaacgatggacggaggagttgatgttcttcggggagtgaactacgcatcggctgctggaggaatcttagaagaaaccggtcgccatctcggagagagattcagcatgagaagacaagtggagaacttcgacaagacattaatggagataagtaggggaatagggtcagtaacagagtatatggcaaagtcattggtggtggtttcattggggaacaatgactacattaacaattacttg

SEQ ID NO: 422 - DNA, 732 bp, Brassica napus
gatcactatcactaaaacaaagaacagaaatgggaacttcagtaataaaagctctcaaatatcttctacttttcaacatctccttgaccttcatctacaccaatgaagtctccgcttctccagtgactctaccggcggcaaagatgagccgtagacttgtggcggttcaaggcatggtttattgcaagtcttgcaagtactccggcattaatacgctcctagaagcatctcctcttcaaggagcgactgtaaagtttgcatgcaacaacacaaagagaggtgtgacgatggagacaaagacggacaaaaacggatactttttcatgttagctccgaataaactcaccacctacggtttccacacatgccgggcttggcccacgaacccaggtcccgcggctgctacggtgacatgcaccgtcccttcacagctcaataatggaaccaccggtgctatgcttaagccttctaaatcaatcaacatagctgaacgcggctacgttttattctctgttggtcccttcgcgtttgaaccggcatgtactcgttgaagtctcgactttcttctttatgtatgtgtgtgcttgcttgttatgactatccatcactagtgctttaaatgttttcatcgtcgtgtttgcttttttagtatgttcacgttttaaagctcgtcttggtagacattttgagattgttggtgtgttgattttcctatatatcctttttgctttt

SEQ ID NO: 423 - DNA, 639 bp, Brassica napus
gaacattcatctcaaatggctgcacttgattacctagtggctgttgagagcgatatatttgttccaactaatgatgggaacatggcaagagtcgttgagggtcatcgcaggttcttgggatttaagaagacaattcagctgaataggaagttcctagttaagttgatagatgaatataccgaagggttgttgacttgggatgtgttctcgtccatggtgaaggcgtttcactctactcgaatgggaagcccgaagagacggttagtgattcccaataaaccgaaggaagaagactacttctacaccaacccgcaagaatgtctgcagctgttagatgaaccattgagagtcatttgaagaaggtgacttcaccattggggagagaacggctgaaaatttgtgttaaaagccttagtttacagtctgaaagatgaagttacagtgtgttttttacagatttaagttacttagggttcttggtgaatagatttctgaaaaagcttccatggatggagaggaaaaaaatgttgattgaagcttacattgtatagtttggcatccatggccttgtcagttttgttagctaaaaataaaaagtgccgttttatgtaattaaagttgggtacatttatattatat

SEQ ID NO: 424 - DNA, 674 bp, Brassica napus
gaggtcacaaggggaacaagagagcttcctcggtttcctccgcctcacgagaatgccgctcaaacattcttcgccggacaccatatcctcctcctccgactccgtccgcctcctctcccgcgaaaccctccgcatcagcgcctccctcgcctcccctcccgacgatctcctccctcaggctctccccgattcttcccactttctccgctcaacgctgagactgatctgctgcgaggaaatcgacggccggagatggaagtacgtcgccgagagcgatggctcggggaaattcaagaggaactcggtggttcgtgctgtaagcttggagtctcctcggactccttttgatgaagtgggttcgtttctgagatcttacgttgtacctgaaggcttccctgcaagtgttaatgagtcttatgttccttacatgacctttcgagctttgaagcatttctttggtggagcgatgggtgtgtttaccactcaaacccttctcaattcagttggagcctcacggaacagttctgattctgctgctgttgcaattaattggattctcaaggatggtgctgggcgtgttgggaaaatgctttttgcgcgtcaggaaaagaaattcgattatgattagaaacagttacggttggctggtgatcttttgatggagctgggtgctg

SEQ ID NO: 425 - DNA, 989 bp, Brassica napus
ggaattgtgtaaggcttcaaaggaggtcacaagtggaacaagagagcttcctcgtttcctccgcctcagacctcttccttcttcctccgctcgctcacaagaatgccgctcaaacattcttcgcctgaccccatatcctcctccgactccatccgcctcctctcccgcgaaaccctccgcatcagcgcctccctcgccgcccctcccgacgatctcctcccacaggctctccccgattcttcccaatttctccgctcaacgctgagactgatctgctgcgaggaaatcgacggccggagatggaagtacgtggcggagagcgatggctctgggaaattcaagaggaactctgtggttcgtgctgtaagcttggagtctcctcggactccttttgatgaagtgggttcgtttctgagatcttacgttgtacctgaaggcttccctgcaagtgttaatgagtcttatgttccttacatgacctttcgagctttgaagcatttctttggtggagccatgggtgtgtttaccactcaaacccttctcaattctgttggagcctcacggaacagttctgcttctgctgctgttgcaattaattggattctcaaggatggtgctgggcgtgttgggaaaatgctttttgcgcgtcagggaaagaaatttgattatgatttgaaacagttacggtttgctggtgatcttttgatggagctgggtgctgctgtggagttaggaactgctgccgttccgcacctttttcttcctctagcttgtgctgctaatgttgttaagaatgttgcagcagtaacatcaacgtctactcgtacccccatctataaagcctttgctaaaggagagaacataggagacgtcactgctaagggagagtgtgttggtaatattgcagatctgatgggaactgggtttagtatattgatatccaaaagaaatccttcgttggttacaacctttgtcttctatcatgtggc

SEQ ID NO: 426 - DNA, 990 bp, Brassica napus
ggaattgtgtaaggcttcaaaggtaggtcacaagtggaacaagagagcttcctcgtttcctccgcctcagacctcttccttcttcctccgctcgctcacaagaatgccgctcaaacattcttcgcctgaccccatatcctcctccgactccatccgcctcctctcccgcgaaaccctccgcatcagcgcctccctcgccgcccctcccgacgatctcctcccacaggctctccccgattcttcccaatttctccgctcaacgctgagactgatctgctgcgaggaaatcgacggccggagatggaagtacgtggcggagagcgatggctctgggaaattcaagaggaactctgtggttcgtgctgtaagcttggagtctcctcggactccttttgatgaagtgggttcgtttctgagatcttacgttgtacctgaaggcttccctgcaagtgttaatgagtcttatgttccttacatgacctttcgagctttgaagcatttctttggtggagccatgggtgtgtttaccactcaaacccttctcaattctgttggagcctcacggaacagttctgcttctgctgctgttgcaattaattggattctcaaggatggtgctgggcgtgttgggaaaatgctttttgcgcgtcagggaaagaaatttgattatgatttgaaacagttacggtttgctggtgatcttttgatggagctgggtgctgctgtggagttaggaactgctgccgttccgcacctttttcttcctctagcttgtgctgctaatgttgttaagaatgttgcagcagtaacatcaacgtctactcgtacccccatctataaagcctttgctaaaggagagaacataggagacgtcactgctaagggagagtgtgttggtaatattgcagatctgatgggaactgggtttagtatattgatatccaaaagaaatccttcgttggttacaacctttgtcttctatcatgtggc

SEQ ID NO: 427 - DNA, 1340 bp, Brassica napus
ggacaaccagaaactatctctctctctctctttttttgtctcttttacaaatatccaatagaatattaaccaatggagtcaccaagtcttccagtaacggcaaaagactggacctccaccagtctccaccgtgtactatgtatgcaaggcggtgaaggtgacgtcagctacgtcaacaattccgattgccaagctttggctataaccttatgcaaaccaatccttatctcatctctccaatccatcaaactcttcacctctccgatcatcagaatagctgaccttggctgcgccaccggctccaacactttcgataccgtggatacggtggttgagactttacgtcagctattcactgcggtgtatggcggtggatcgctggagtttgaggcttttttctgtgacttgcctagtaatgacttcaacatgttgtttagattgttgtctgagaaacagaaagttgactcggccaagtatttcgccagcggcgttgctggctcgttctgtgacaggcttttcccgagaggaacgatccatgtcgctgtgagcttaagtgctctacattggctctctcagataccggagaaagtactggagaaaggatcaagaacgtggaacaaagggaaaacgtggatcgaaggagcgaagaaagaagtggttgatgcatacgcagaacaatcagacaaagatttggatgatttcttgaagtgtcggaaagaagaaatggtggagggaggagtgttgtttgtgttaatgggtggtcgtccttcaggttcaagtagtcaatttggtgatcaggatactcgagccaaacatcctttcacaactaccatggaacaagcttggcaagatttaatagatgagggttcgatagatgaagagacaagagacggattcaacataccggcgtacatgagaagtccggaggaagtggctgccggaatagaccgtatcggtggtttcaagatagagaaaatggaatacatgaaaatcgttgaatcctccgacgagaaacatgaggagtggaaaaaagatcccgtttcgtacggacgagccaggaccaacttggttcaagctgctattcgtcctatggtcgacgtctatcttggaccggacctatgcgatgagctcttcaaaagatatgaaaaccgggtttctacaacccgagaatttcttcatataacttgtttctttggagtcgtcgctttttctgccatccgaattgaatgattatatgtttatagcgttatgtatgaaatgtgtttgttcgaatttatctatatatatggtttgtcgtttgttttaatatatatgaatgtgtgtcgcgtttacccaaaaaa

SEQ ID NO: 428 - DNA, 522 bp, Brassica napus
tcaagaccwmatcggtggtcttcaagtccttcatcaagactgttgggtcgatgtctcgcccatccccggggctcttgtcatcaacatcggagacttcttgcagttgatgacgaacgataagttcaaaagcgtggagcatagggttcttgctaacaaagctggaccgaggatctcagtggcgtgctttttcagctcgagtgtgattccgaattctacggtttacggaccaatcaaagagcttgtgtctgaagagaaccctccgaaatacagagagttcactatacctgagtactcaaagggatacattgagaaaggtcttgatggaacatcgcatttattgaattataagatatgagaaaacacttcaaaagagtgcgagcgtcttgtttgtgtgtgtttatcagtcagcttgcaactgttgtgttagtctttatccatgttaagctactctgttgattttgtcgaataataactcggtcagagcatcaaatgaaaaaaacaaaccaacaaaagagaaaaaag

SEQ ID NO: 429 - DNA, 249 bp, Brassica napus
ttcaacaccaaactcaatgcgacttcgcaggatcttaagagaaacctcattggactcaacttagtcgtcttcgatatctatcagcctctctatgatctcgccacaagaccatccgaatttggatttgcagaggcaagaagagcatgttgtggaacaggactactagagacatcaatactgtgtaaccctaaatcagtagggacatgtactaatgcaactgagtatgtattttgggacgggttccatcca

SEQ ID NO: 430 - DNA, 2063 bp, Brassica napus
gttcatctctcttctttaagaccaaaacctttttctcctcctcttcatgcatgaaccctaactaagttcttcttcttttaccttttaccaagaactcgttagatcaytytctgaactcratgaataataactggttaggcttttctctctctccttatgaacaaaatcaccatcgtaaggacgtctrctcttccaccaccacaaccgycgtagatgtcgccggagagtactgttacgatccgaccgctgcctccgatgagtcttcagccatccaaacatcgtttccttctccctttggtgtcgtcstcgatgctttcaccagagacaacaatagtcactcccgagattgggacatcaatggtwgtgcatgyaataacatccacaaygatgagcaagatggaccaaarcttgagaatttccttggccgcaccaccacgatttacaacaccaacgaaaacgttggagatrkmrrtggaagtggstgttatggaggaggagacggtggtggtggctcactaggactttcgatgataaagacatggctgagaaatcaacccgtggataatgttgataatcaagaaaatggcaatgstgcaaaaggcctgtccctctcaatgaactcatctacttcttgtgataacaacaackacagcartaacaacsttgttgcccaagggaagactattgatgatagcgttgaagctacaccgaagaaaactattgagagttttggacagaggacgtctatataccgcggtgttacaaggcatcggtggacaggaagatatgaggcacatttatgggataatagttgtaaamgagaaggccaaacgcgcaaaggaagacaagtttatttgggaggttatgacaaagaagaaaaagcagctagggcttatgatttagccgcactcaagtattggggaaccaccactactactaacttccccatgagcgaatatgaraaagagrtagaagagatgaagcacatgacaaggcaagagtatgttgcctcactkcgcaggaaaagtagtggtttctctcgtggtgcatcgatttatcgtggagtaacaagacatcaccaacatggaagatggcaagctaggataggaagagtcgccggtaacaaagacctctacttgggaacttttggcacacaagaagaagctgcagaggcatacgacattgcggccatcaaattcagaggattaaccgcagtgactaacttcgacatgaacagatacaacgttaaagcaatcctcgaaagccctagtcttcctattggtagcgccgcaaaacgtctcaaggaggctaaccgtccggttccaagtatgatgatgatcagtaataacgtttcagagagtgagaatagtgctagcggttggcaaaacgctgcggttcagcatcatcagggagtagatttgagcttattgcaccaacatcaagagaggtacaatggttattattacaatggaggaaacttgtcttcggagagtgctagggcttgtttcaaacaagaggatgatcaacaccatttcttgagcaacacgcagagcctcatgactaatatcgatcatcaaagttctgtttcggatgattcggttactgtttgtggaaatgttgttggttatggtggttatcaaggatttgcagccccggttaactgcgatgcctacgctgctagtgagtttgattataacgcaagaaaccattattactttgctcagcagcagcagacccagcagtcgccaggtggagattttcccgcggcaatgacgaataatgttggctctaatatgtattaccatggggaaggtggtggagaagttgctccaacatttacagtttggaacgacaattagaaaaaatagttaaagatctttagttatatgcgttgttgtgtgctggtgaacagtgtgatactttgattatgtttttttctttctctttttctttttcttggttaatttcttaagacttatttttagtttccattagttggataaattttcagacttaagggtcacttctgttctgacttctgtctaatacagaaaagttttcat

SEQ ID NO: 431 - DNA, 752 bp, Brassica napus
ggacacaaaaccggagagmgagagagagaragrgttgkaggttatactcttacacgcaaagaagaagatctaagatggcatcatcatcatataacgcaagcgttgttccttcatcatcatcctctgctcagccgttcttcctcactggctccggcgtcggagagaacgactttggccagaaagatacttttgtgtcaatgattcaacaacctaactcctcagctccaccacccaagaaacgaagaaaccaacccggaaacccaaatcctgatgcggaagtggtagctttatctccaaagacaataatggctacaaacaggttcatatgcgatgtatgcaagaaagggtttcaaagagaacaaaacctacagcttcaccgaagaggacacaatctcccatggaaactcaaacagaagtcaaccaaagaagtaaagaggaaagtctatctttgtccggaacccacgtgcgtccaccatgacccctcacgtgctctcggagacctcaccggaattaagaagcactattaccgtaaacatggagaaaagaagtggaagtgcgataaatgttctaagcgttacgctgttcaatcggatdggaaagctcactctaagacctgtggtactaaagagtatcgatgtgactgtggtaccatcttctctagacgcgatagttacattacacacaggcyttctgtgatgcattgatacaagaaaccgccagaaacccaccgtgacctcacctcagtgacagct

SEQ ID NO: 432 - DNA, 1158 bp, Brassica napus
gaaacacattcattatcaaagaggcaagagcaaaaaatatgtttaaactcagtctcgttctcgtatttcttattgcattttcaggaatagatgcaagtccgatcaaataccataatcctagctgctcagggaatatgtcagcgacagatgtagacctagttcatttcgcaatgaacttggagttcaccgaagccgaattcttcttgaaagcatctacaggaaaaggactcgatgcgtttaatgcaacacttgctaaaggcggaccaccccccattggagccaagaaggccaatcttgatcctataactaatcgaatcatcgaggagtttggttatcaggaaattggccatcttagggcgattgcggatatgacgggagggattccgcgtccgctgttgaatctaacgagagagaactttgccatgtttatggacagagcggttggacgtagatcaaacccgcggttcgatccttatacgaattcactcaactatcttttagcatcatactacatcccttatgttggcctcactggttatgtcggagccatcccttaccttgtctacttcaacatcaaacggcttgtggcgggtcttttgggggtggaatcgggtcaagacggagtaataaggacgctcctttacgagagacagwacgagaaggtggaggaatacggaggagtcacggtggctgagctaaccaacgagatatctaacctccgtaatgaactcggtatgtgcgggatcaaagacgaaggctkgtgcgtgccactgtggctaggtgcggaaaatcgcaccactagcaacatcctctccgccratccatactctctctcttatgaccgaacaccacaagaaatcctcagggtcatgtacggcaccggcaatgagcgccggcccrgtgggttttggccgtgtggtgccaacgggaggatcgccaggatgtytcttgatgagaggtatcatggtaattacgatgcatgtycagatggcaaaaattwaaaacttctattgatatactactagaaaatwaaataattgttaagattgtattatcattcttaacaatattataattctgtgtttaaccaaaataaagaaacacctggttcttataatgtatcagagtgaagaagagttggtaatggatatatctatg

SEQ ID NO: 433 - DNA, 729 bp, Brassica napus
  misc_feature (712)..(712): n is a, c, g, or t
gttagaatccgggtaagcacaatacgaagcaaagagagagagagagatagggtagcattagatacggaacggtccacttaagtaccgtgtttcattttgattctctcaatcactctcgtctcccttcatttttcttttactattattattttctctgaacttgatcaatcttattgatctagaaaatgaagctcgagtatttggattacatattggtgccattaggtatgggtttgatggtattctatcatctctggcttctccaccgcatcatccaccgtccatcttccaccgtcgttggcctcaacgccttcraccgccgcctctgggtccaagccatgatggaggattcatcaaagaacggcgttctagcggtccaaacgctaagaaacaacataatggcatcaactctattggcatcaaccgcgataatgttgtgttcactaatcgctgtcctaatgactagcggtacaggagaacgatcggtctggtttgtgtttggagacaaaagcgaccgagccttctcgatcaagtttttctcaatcctcgtttgcttcctagttgcgtttcttctcaacgtccaatcgatacgttactacagccatgcaagcatcctcatcaatgtccctttcaaaaagctcatggctgtttcttcagatggtcatggtcgtggtagtcttatgataaaccaagactatgtggctgcgacggntaaccgtgggagctact

SEQ ID NO: 434 - DNA, 1361 bp, Brassica napus
ggccttaggaatcaaagaaagcttcttgataacggaataggagatgttgctgagctcaagaagctttacaaagataagttctggaaagcaagcgacaagatggttgactacctccgcagctctatcggcatcatacacagaaaccacgctgagagcataacaacgtttatcaaagaaagcgtggacgatgagctcaaggagcctaatgtgaacgtgaagaagcgtctgacgttttgtgttgaagggaacataagcgtcggcaaatcaactttcttgcagaggatagctaacgagaccattgagctgcgtgaccttgttgagatagttcctgagccggttgataagtggcaagacgttggaccagaccactttaatatactagacgcgttctactctgagcctcagaggtatgcttatactttccagaactatgtgttcgtcacgaggctgatgcaggagaaagagtctgcttcggggattaagcctcttaggttgatggaaaggagtgtcttcagtgacagaatggtgtttgtgagagctgttcatgaagctaagtggatgaacgagatggagattagcatatacgactcttggtttgatcccgtcgtatctgctttacctggacttgttcctgatgggtttatatacttgagggcgagtccagacacttgccacaagagaatgatgctcaggaaacgagcggaagaaggtggagtgtcacttaagtatctacaggatctgcacgagaagcatgagagctggctgctcccgtttgagagtggaaaccatggggtgctctccgttagtaaaccgtctttgcagatggataactctcttcatcctgatatcaaggaccgtgtgttttacttggaagggaatcatatgcattctagcatccagaaggtgcctgctttggttttggattgtgagccaaatattgatttcagcagagatgttgaagcaaagagacagtatgcacggcaagttgctgagttctttgagtttgtgaagaagaagcaagaaacgtcacaggagaatagctctccgttgctgatgcctcctcataatggaggtctctggatgggaccagaagggaagcatgtcccgggactagaactcccctctctggatttcaggaaggcgatgtcgctcataaccagatcgtctgcgtgagactgccccccatggactcagttttttgttttgttttgaatgctctgaaggagcattgtccggttatggaatgtcaataggtatggtcggctttatgtttcgtttgttttaggaaacttctctctacggctttttacctctcttaggatagttataacccttttgttcgagaagaaaaatgatgtctg

SEQ ID NO: 435 - DNA, 1359 bp, Brassica napus
ggccttaggaatcaaagaaagcttcttgataacggaataggagatgttgctgagctcaagaagctttacaaagataagttctggaaagcaagcgacaagatggttgactacctccgcagctctatcggcatcatacacagaaaccacgctgagagcataacaacgtttatcaaagaaagcgtggacgatgagctcaaggagcctaatgtgaacgtgaagaagcgtctgacgttttgtgttgaagggaacataagcgtcggcaaatcaactttcttgcagaggatagctaacgagaccattgagctgcgtgaccttgttgagatagttcctgagccggttgataagtggcaagacgttggaccagaccactttaatatactagacgcgttctactctgagcctcagaggtatgcttatactttccagaactatgtgttcgtcacgaggctgatgcaggagaaagagtctgcytckgggattaagcctcttaggttgatggaaaggagtgtcttcagtgacagaatggtgtttgtgagagckgttcatgaagctaagtggatgaacgagatggagatwagcatatacgactcttggtttgatcccgtcgtmtctgctttacctggrcttgttcctgatgggtttatatacttgagggcgagtccagacacttgccacaagmgratgatgctsaggaaacgagcggaagaaggtggagtctcgcttaagtatctacaggatctgcacgagaagcatgagagctggctcctaccgtttgagagtggaaaccatggggtgctctccgttagtaaaccgtctttacagatggataactctctbcatccggatatcaaagaccgtgtgttttacttggaagggaatcatatgcattctagcatccagaaggtccctgctttggttttggactgtgaaccaaatattgacttcagcagagatgttgaagcaaagagacagtatgcacggcaagttgctgagttctttgagtttgtgaagaagaagcaagaaacgtcacagagagaatagctctccgttgctgatgcctcctcataatggaggtctctggatgggaccagaagggaagcatgtcccgggattagaactcccgtctctggatttcaggaaggccatgtcgctcataaccagaccgtctgcgtgagactgtcccccawggactcagttttttttktttttgatgctctgaaggagcattgtccggttatggaatgtcaataggtatggtcggctttatgtttcgtttgttttaggaaacttctctctacggctttttacctctcttaggatagttataacccttttgttcgagaagaaaaatgatgtctg

SEQ ID NO: 436 - DNA, 697 bp, Brassica napus
ggaagagaaatggcttcttcttcttcttcggctgctctttatagaatctcaaatctccagaatcatatctcccctcttgaagccaacaacaagctaaggagtctggtgaagatatctccacaagtatctgaagccatatccagtggacgtgctgtggtcgctcttgagtcaaccattatctcccatgggatgccttaccctcaaaacctgcaaacagcaaaagaggtggagtctattgtgagagagaatggagcagttcctgccacaatagctatcttgaacggagttccttgcataggtctgaacgaagacgagcttgaacgtcttgcatctctggggaaaggtgtccaaaagactgcaggcagggacatagcatatgttgtggctacaagaggaaatggtgctactacagtctctgcaaccttgtttttcgcttctatggttggcatccaagtctttgtaaccggtggaattgggggtgtacataggcatgccaaccaaactatggacatatcatctgatcttactgcacttggaaggactcctatagctgtgatatcagcaggcgttaaatccatacttgatattccaaagactcttgaatatttggaaactcaagaagtgtatgttgctgcatacaagagcgatgagtttcccggcatttttcacagaaaaaagcgggtgtaaggcaccttct

SEQ ID NO: 437 - DNA, 607 bp, Brassica napus
gaacacataaaggtcgaatctttccgttggtaagttaagagtgtgattcagagagaaatggcttcatcttcgtcctctctttccagaatctcaactctccagaatcatatctcccctcttgaagccaacaacaagctaaggagtctggtcaagatatctccgcaagtgtctgaagccatatccagtggacgtgctgtggtcgctcttgagtcaaccataatctcccatgggatgccttaccctcaaaatctgcagacagcaaaagaggttgagtcaattgtgagagaaaatggggcagtccctgcaacaatagctatattaaacggagtgccttgcataggtctgaacgaagaagaactagaacgtcttgcatccctggggaaaagtatccaaaagactgcaggcagggacataccacatgttgtggcgacaagagcaaatggtgcaactacagtctctgcaacgttgtttttcgcttcaatggttggcatccaagtttttgtaaccggcgggataggaggtgtgcataggcatgccaaccatactatggacatatcatctgatcttactgcactaggaaggactcctatagcagtgatatcagcag

SEQ ID NO: 438 - DNA, 605 bp, Brassica napus
ggagcatagaaactatggaactagagggctcgagtagttgcccgaggccgctaccgtcaaaggcggagatgagccgtggagcgtatttggcatgggaagacttaacggtggttatacccaacttcagtgatggtccgacccgaaggttgctacagaggctaaacgggtatgctgaaccaggtcggatcatggctataatgggtccttctggatccggaaagtccactcttcttgactctcttgcaggtagactcgcaagaaacgtgatcatgaccggtaatcttctattgaacggcaagaaagccagactagactatggtctcgtagcatatgtaacacaagaggacatattgctcggaacactaacagtgagggagacaataacatactcagctcgattgaggctttcaagtgacatgtctaacgaggaagtgagtgacattgtggaaggcacaatcatggagcttggtcttcaagactgcgcagacagagccattggaaactggcacgctaggggagttagtggcggcgaacggaaacgtgtcagcatcgctttagagatcttaacgcgccctcagatcctctttctcgacgaacccaccagc

SEQ ID NO: 439 - DNA, 867 bp, Brassica napus
gggtcgaacgatggcgtctctcaaaattcctgcaaatgttcctcttcctgaagaagactccgagcagctccacaaggcctttaaaggatggggaacaaacgaggggatgatcatatcaatcttggcacatagaaacgcagcgcaacgtagcttaatccgtgctgtttatgcagctaactacaacaaaaaccttctcaatgaattagacaaagagctatccggtgactttgagagagctgtgatgttgtggactcttgagccagtagagagagatgcatatttggccaaagaatctaccaagatgttcaccaaaaacaactgggttcttgttgaaatcgcctgtactagacctgctcttgagtttttcaaagccaagcaagcataccaagctcgctacaagacctctcttgaggaggatgttgcgtaccacacatctggagatatccgaaagctattggttcctcttgtgagcacctttaggtacgatggaaacgctgatgaggtcaacatgaagctggcttcttcagaagctaagacacttcacaagaagattactgagaaggcttacactgatgaagatctcatcagaatcctgacaacaaggagcaaagctcagatcatggccacccttaatcacttcaaggacaagtttggaagttccattaacaagtatttaaaggaagattcagaagatgaatatgttcaactactcaaaaccacgatcaaatgcttgacatatccagagaagtactatgagaaggttctacgtcgagccatcaacaaggtgggtacagacgaatgggcactcactagagtggtcactacacgagctgaagtcgacatggagcggatcaaagaggaatactt

SEQ ID NO: 440 - DNA, 707 bp, Brassica napus
gcaagcttgccttkgggtttgagcttcttcttctccttctccttcttcgcctttactctttctcttgatcattccaaaacctctttcttttggtaaattcttaaaaacaaccaaagacaatggaaatgaaatggctattaacctcggctttcactcaaatgtttggctactcaaaccaaatcagtcaaaccagcaacagcctaagcacccgcaacaaaataaagatgatgaagaaagaggaatacccaagagggtttcaagttcctcttcactatcctaaatactccaagtctgattatgaagccatggacgatctcagccttgacttgctcctcaaacaatatggaatctccttcgaaggatctcttgaagacaagagggtctttgcaatggagtcatttctctggcctgatcagctttagggtttttgtatgtttggtgtctgaatatccaaatctctctccccacaaacgtccgatcgtatcaagtagtctcatataattaaaatgtttcagaataataaatcaccatataatatgtatcaatcaattagtagtaatcagtaatcacgtttgtgtgttatatgtatgtatgtggtatggagaagttttgaagcatgtaatgtacacatatgtaaccaccatgagtgcattataacatctttcatgtatatattctaaacatgtgatctatggacttatgattat

SEQ ID NO: 441 - DNA, 535 bp, Brassica napus
tcctttatcatcttccttcacctctctctttccccctttccgtacaacacaacrarkggcvcgaggctcttcccagtcccaacaatcaacctccaccgcttcctcaaccgccaggcccggtctggccgctccccgtggatccgccgccgctacggcgggcatgcgtcgtcgcaggctcggtggcggtgggagcgcgtcatcagggggcggatccgtcgctggatcaggatcgagcaacatgctgagattctacacagacgaagctcctggactgaagatttcacctaccgtcgtcctcatcatgagtctctgcttcatcggctttgtcaccgctcttcacgtcttcggaaaactctacctccacaagtccggatccaaagcttagatccggatccggatctcttcttccctatgttgaatcagtggtctctcttgtttctttttacttgtgttcttttttggtttcttgtttcttgaatcttgatgatccgtgtacaaccgcttaactttgaataaaacatgtttacttacgaat

SEQ ID NO: 442 - DNA, 947 bp, Brassica napus
aaaaacattaaaaaaatggaagaggaaatgaagaagaagcaaggaaaaggagaactagaaggtgaagcacaaaaatgtccaagatgtgaatctccaaacacaaagttttgttactacaacaactatagcctctctcaacctcgttacttctgcaaatcttgtcggagatattggaccaaaggtggtactctccgtaacgtccccgttggtggtggttgccgtcgaaacaaacgatcttcttcatctttctccaagaacatcaataagcctatcaatttccacaatgatccacttcacaatcctttaattacgggaatgccatccccctttagttatgactccattgatctcaacctcgctttcgctgctcttcataaacatcccccttctcaggttacaccttcttttgggtttggaggcgatgtttctatttatggaaactcgacaaacacacacactggtgttctaaacgggttgaacattggagggcaaaacggtaatttcaacgggggtagtttgtggtatggtttcatgtccggaaatgatagtgaaaacaagacaacttcggctttggggattcctctggagggaaacgagagaaagcaagagaatgtgaacaacaacaacaatatcttggagaatccmagcaaggttttattggggtttccatggcaaatgtccgggaattcagctggcggtgtaccggagactgatccgggaagggaaagctggaatgggtttgtttcatcttggagtagtggtttacttaacactcctttggtctagttcaagatatctaataaagtaataatattactatatgttgaagtttatgtcatcacatgtttgtacaccactgtcaccatatgggggatgtttggtctagggtttcaatcgcttttagtttcccacttttcttgagcctatagaccaaagagttctctaga

SEQ ID NO: 443 - DNA, 498 bp, Cucumis melo
atctcatttgcgcctcccggatcatcctctcaaaaatgacgacatcgcggcgtcttgcggatcggaaggtggagaggtttgagaagaacattttgaagagaggggctgtgcctgagactgctactaagaagggaaaagattaccctgttggccctattcttcttggattcttcgtttttgtcggcattggatcatctctgtttcagataatcaggacggcaacaggtggaggaatgggatgagagccatcttcaattctgatgagaggggtagcaggcaggacatgaggttaaaacttattgagttaatttgtttgtactatctgttctctgcctatttgtcctatcctctaggagaagtttagaaagtaaagagtaagtaagaccatttatggtcatcctgtgaattactcttattaaaaaaaaagtaatttaaataacagtgcacatgcctaagtgctatgctatatgctatatcctatatctaatcgttttgttc

SEQ ID NO: 444 - DNA, 1102 bp, Saccharum officinarum
ggttccacttccaccaacaactggctgggcttcgcctcgttctccggcgccgccgacgccgtcctgcacccgctgccgcctcaaggcgaggcagatgccgaggcgccgatgctggaagacttcctcggcttgcaggagccgactgctccggtggccgctagaccgttcgccgggagcggcgcaagctctatcgggctgtccatgatcaagaactggctgcgcagtcagccggcgcctgcacctgcgggggtcgactccatggcgctggcgacaacggcgacatcgcctgagaggagcaggaaggtggtcgacggcggggagagcggtggcatcatcttggtggacactgcgcagcagaggaaggcctcggtggacacattcgggcagcggacttctatttatcgcggcgtcacaaagcatagatggacaggaaggtatgaagcccatctttgggacaatagctgcagaagagaaggtcagactcgcaaaggcagacaagtatacctaggtggatatgataaagaagagaaagctgccagggcttacgatttagctgctctcaagtattggggcactacaacaactacaaattttccaatgagcaactatgaaaaagaactggaagagatgaagcatatgtcacgacaagaatatgttgcgtcgcttagaaggaaaagcagtggattttctcgtggtgcatcgatttaccgaggggttaccaggcaccaccagcatggaaggtggcaagcaagaataggaagagtggcaggaaaccaggatctgtatttaggcaccattcagtacccaggaagaagccgcagaggcttatgacatcgctgcaatcaaattccgaagcctcaatgctgtgaccaactttgacatgagccggtacgacgtcaagagcattatcgagagcagctccctgccagttggcagcaccacgaagcgtccgaaggatggaaccgataaatctgacataggtgtgaatggcaattgttgctgaggctgccgacctatgactgctacaaacctgctcactgatggcattgcagctatagtcctgagcgattgggtacagtggctggtcgtccccggctgcatg

SEQ ID NO: 445 - DNA, 631 bp, Saccharum officinarum
  misc_feature (567)..(567): n is a, c, g, or t
cctgccgatggttgtggccggcggcggcgccagcggagcggctttggagagcacgtcgtcggagaacaagcgagcgagcggcgccatagattcgcccggcagcgcggtagaagccgtcccgaggaagtccatcgacacgtttgggcaaaggacctctatatatcgaggtgtaacaagacatagatggacagggcggtatgaggctcatctatgggataatagttgtagaagggaagggcagagtcgcaagggtaggcaagtttaccttggtggctatgacaaggaggacaaggcagcaagggcttatgatttggcagctctcaagtattggggcactacaacaacaacaaatttccctataagcaactacgagaaggagctagaggaaatgaaacatatgactaggcaggagtacattgcatacctaagaagaaatagcagtggattttctcgtggagcatcaaaatatcgtggagtaactagacatcatcagcatgggagatggcaagcaaggatagggagagtcgcaggaaacaaggatctctacttgggcacattcagcacccnagaggaggcggcgggaggcctacgacatcgccggcaatcaagtttccgcgggtctggaacgccg

SEQ ID NO: 446 - DNA, 615 bp, Brassica rapa
acggacatgcgctgaacacaacaaacgattctttttaagagaatctctctctctctattctctccacttctctctctgtggatcgatggcagcttcggttgatcctttggtggttggaagagtgatcggagatgtgttggacatgttcatccccaccgccaacatgtctgtctactttggccccaaacacataactaacggctgcgagatcaaaccctctgccgcagtcaaccctccaaaagtcaacatctccggcaactccaatgagctttacactctcgtgatgactgacccggacgcacctagcccgagtgagccgaacatgagagaatgggtccattggattgtcgtggatatcccgggaggcaccaacccctcaaaaggaaaggagatactgccatatatggagccgagaccaccggtggggattcaccgttacatatttgtacttttcaggcagaactcaccggtgggtatgatggtgcagcagccgccttcgcgagccaacttcagcacccgaatgttcgctggacatctcgatcttggtttgcctgtggccacagtttacttcaacgcccagaaagagccagcttcacgcagaagctgatgcacgca

SEQ ID NO: 447 - DNA, 342 bp, Brassica rapa
gcgaatatggggttagcacagtggcggcaaagtatattatgaaatgcgacgatgatacgtttgttcgagttgatgctgtgatacaagaagcagagaaggtcaagggaagagatagcctttatattggaaacattaacttctaccataagcctctgcgcactggtaaatgggctgtcacatatgaggaatggcctgaagagtcttatcctccatatgcaaatggtccgggttcatcttgtcatatgacatagctaagttcatcgtcgatgatttgaacagcagagattaagattattcaagatggaagatgtgagcatgggaatgtgggtggagaagtcaaca

SEQ ID NO: 448 - DNA, 434 bp, Brassica rapa
gaaaccttaaaaaggcagaagcaactaatccgcaacatcttgcttttagtttcttgcgtaacaaagatttagcttggaggattaatggcggacgttcgcacacatgctcaccaggttcaagtgcaccctctacgccagcaggaaggaggcatcaaagtggtttatccccagagcgggccttcttccactcwggttctagcagtgatcgccggtgtaccggttggagggacgctgctaactctggccggtttaactttagccggttcggttataggactaatgctggcattcccgctgttcctcatcttcagtccggttatcgtaccagcggcctttgtgatcggtttagctatgacaggattcatggcgtcaggggcaatagggctcacgggactatcgtcgatgtcgtgagtactgaaccacatccgaagagt

SEQ ID NO: 449 - DNA, 702 bp, Brassica rapa
ggagctactgatttgcatgcaaggctagtgacactaagaagcggagaaaatgagaaatatttactttctagtcttatttctgttgagcatcttgatctccatacatgcttctttgcatgtgaagtatcttcctggtcttgaaggtcctcttccttttgagctcgagacagggtatgtgagtgttggtgaatctggagatgttgagctcttctactactttgtgaaatcagagagaaatccagataaagatcctctcatgatttggctcactggtgggcctggatgcagctccatttgtggtttactctttggaaatggtccattggcatttaaaggggatgtgtataatgggacagtgcctcctttagagctaacatcttattcttggacaaaggtggctaacattttatatttggaatctcctgctggttctggatattcttatgccaaaactcggcgtgctgctgagacgagcgacaccaaacaacttcaccaaatcgaccagttccttaggagttggtttgtggatcaccctgagttcatatcaaatccattttatgttggtggagattcatactccgggaagattgttccaggagttgtgcaacagattttacttggaaatgagaaaggtctcacaccactgataaatattcagggatatgttcttggaaaccctacggtaagtgcaaactttgaatc

SEQ ID NO: 450 - DNA, 703 bp, Brassica rapa
gaccaaaccctaatctcatttcttcacctcctcttctcaaaacttcctatcttcttcaagaaaaacacaaaattttctcaataattcaaaaaccctaaaatcaagacagagaaaacaactccttaatcatagggttgtcatgagcggcggtgggaacacaatcccctccgtgggaggtgctggttgtggtggtggtggaggaagtagcagcggtggaggaggaagtagtggcggtggtggtgggccatgtggtgcttgtaagtttttaaggagaaagtgtgttccgggttgcatattcgcaccatacttcgactcggagcaaggctcggcttattttgcggcagtgcataaagttttcggggcaagcaacgtctcaaagcttctcttacacataccggttcatcgacgggccgatgcagttgtaaccatttgctatgaagctcaggctcggatacgggatcctatctatggttgcgttgctcacatatttgctcttcagcaacaggtggtgaatctacaggcagaagtttcttacttacaatcccatttggcatccctagagctacctcagccgcaaacgcgaccaccacccataacgcaaccacaaccgctcttcttcactccgcctccgcctcttttcataacagattttgccgcatcagtctcaccatacgatttagccactatagtcgatccaccgacg

SEQ ID NO: 451 - DNA, 619 bp, Brassica rapa
aaaagaatcaaccctacaaacttaactttcaagctcaaacaactttacactatggctttccacttccggcgactttgcatgtcctctgctcttctggtggtagttctccaaatcctgcatggcgtatccggccaacttgttgtggttgaggaccctgtttctgcttctccgccaccattggtcgaacaagacggcagtgatggcattgtgcccgcactgtttgtgtttggtgactctctcatagacaatgggaacaacaataacatcccttcctttgctaaagctaattactttccttatggcatcgatttcaatggaggtcctaccggtaggttctgcaatggcttgaccatggtcgatggtattgcccaactattggggttgccgttgattccggcgtactcggaagctaccggagatcaagtgctacgtggtgtcaactacgcttccgcagcagcggggattcttcctgacaccggaggaaactttgtggggcgaataccgttcgaccagcagattcataactttgagacaacgttaaatcaggtggctagtaagtccggtggtgcagtgacaattgcagactcggtggctcgaagcttgttcttcattggaatgg

SEQ ID NO: 452 - DNA, 629 bp, Brassica rapa
ggagagccttcaattttccttggaaaaaatatttcaaatttgaaagacatgaggaagtctttcactatacaatcattagcatttgttccattgtttgtagtagtggtacatgcagtagtcatcgcagccgaagatgaaaacgaggcaatgtttccagcgatgtttgtgttcggagactcattggtggacaacggaaacaacaaccgcttgaattcgctcgctaggtccaactatctcccatatggcatcgattttgacggcggtcaacccaccggtcgattctctaacggcaaaaccatcgtcgatttcatcggagagttgctggggctgccggacataccagcgtttatggaaacgatggacggaggagttgatgttctccggggagtgaactacgcatcggctgccggaggaatcttagaagaaaccggtcgccatctcggagagagattcagcatgagaagacaagtggagaatttcgacaagacattaatggagataagtaggggaatagggtcatcagtaacagagtatatggcaaagtcattggtggtggtttcactggggaacaatgactacattaacaattacttgaaaccatcggcttttcctcaccagctccatctacg

SEQ ID NO: 453 - DNA, 679 bp, Brassica rapa
ccttctcgtgtgtctgtaaacatgggagctctaaattttctctctggctatttctctgatcatttctacgtctcaataagaaaacggaagaagcgtaaagtcatgcagacggtgaatataaaggtaaagatagactgtgacggatgcgaacgcaaaatcaagaacgcagtttcttccatgaaaggagcaaaatctgtggaagtgaatagaaagatgcataaagtgacggtgagtggttacgtggatcctaagaaagtgttaaagaaagtgcagagcactgggaaaaagaaagctgagctatggccgtatgttccatatactatggtggcttatccgtacgcagctggagcttacgacaaaagggccccaccgggttttgtgaggaagtcggagcaggctcaggcgcagccaggaggtacagacgataagctcatgtcccttttcagcgacgagaaccctaacgcctgcaccatcatgtgaataattttagctcgtgacgttatagggtaacgtcttataaagttgatgttggaacctttcttgttagtgtattgaatcagaagcaaagaaacttatagtaccaatagcatgtaatagatatgtatcagtttcatactatgcgtttacttgcaagtagtggtttatttacttgtattttaatgaataatttagcttgttt

SEQ ID NO: 454 - DNA, 607 bp, Brassica rapa
aagggcaccaccaggagtggagcctgcggcttaatttgactcaacacggggagacaaaaccaaacctatttggtcttttcttgtcttaattctcaaaatttcttaaagatttatagaaaaactcaaagattaaggtttagttctattaccttatcaacatccttattaaaaagtccaatttctttccctaagcttcatattgaaagaagaaaaaaatgggaagaccaccttgttgtgaaaagactggagtgaagaaagggccatggacaccagaggaagacatcgtcttagtttcttacatccaagaacatggccctggaaactggagatctgtccccaccaacacaggtctgaggagatgtagcaagagctgcagattgagatggactaattatcttcgacctggaattaagcgtggcaattttactgagcatgaagaaaagatgattgttcatctccaagcccttttaggcaacagatgggcagccatagcatcatatcttccagaaaggacagacaatgatataaaaaactattggaacactcacttgaagaagaagctcaagaagatcaatgaatctggtgaagaagattatgacgacttctt

SEQ ID NO: 455 - DNA, 685 bp, Brassica rapa
ggaaactctcatactatactctcacataagcatccaaagcaatcaccaccaccaccaacatcttggttataacatttttgtaagaaaaatatgatgggtttctcgaaagagttggaaggaacttggttaaatctttatgtggttgttgtgtctttaatggttcttgagttaattgtggtggtaaaggcacaacttgttccatcgatgttcatatttggtgattcggtggttgatgtgggaaacaacaatcatatctacacaatcgttaaagctaatttccctccttatggaagagatttcacaacccatacacccaccggacgcttctgcaatggaaagctagctaccgacttcaccgctgagaatcttgggttcacatcatacccacaagcttatctaagcaaaaaggcaaaaggaagaaaccttttgattggagctaactttgcctctgcagcttcaggctattacgatggcacggccaagctctacagtgcaatttcattgccgcaacagctggaacattacaaagactacataaaccgaatccaagawatcgccacttccaacaatgcaaacgccacctccataatatcagatggcatttatgtcgtcagcgcggggagcagtgacttcatacagaactactatatcaaccctctcctctacaaagtccagtcacctgatg

SEQ ID NO: 456 - DNA, 348 bp, Brassica rapa
gaaagctgctcgagcatatgatcttgctgcactcaagtactggggtccctctactcacactaatttctctgtggagaattatcagaaagagattgatgacatgaagaacatgactcgacaagaatatgttgctcacttgagaagaaaaagcagtggtttctctaggggtgcttccatctatagaggagtcaccagacatcaccagcatggaaggtggcaagctcggatcggtagagtcgctggaaacaaagatctctaccttggaactttcggaactcaagaagaagcggcggaagcctattgatgtagcagctattcaagttccgtggcacaaacgcggtgactaaa

SEQ ID NO: 457 - DNA, 815 bp, Brassica rapa
ttgttgtgctttacacactatctgaacgggtttggagagtgacaagtggcgctgggatgagttggaagatgatgatcgcgcggcggaggaggctagtgtgctctggtgtaggaaactcgcgctgtacgccatttttttttctctctctctctctctctctctctcaccatcacacataacacagaagagtccatggctgcttcttcatcctctaatgcttccttctttggagttcgagaagaagatcaaactcaccttcttcctccgaatccctccgcggccgtcgctcctcctcctcaccaccagccaccgcagtctcagcaacctcttgaagctccaccgcagaaaaagaagagaaatcaaccaagaactccaaattccgatgcagaagtgatcgctttatctccaaagacactaatggctacaaatagattcatatgcgaagtatgcaacaaaggttttcagagagaacagaatctacaacttcatcgaagaggacacaatctcccatggaaacttaagcagaagtcgaccaaagaggtgaagaggaaagtgtatctttgtccggagcccacgtgcgtccaccatgatccgtcacgtgctctcggagacctcaccggaatcaagaaacattattaccgtaaacacggtgaaaagaagtggaaatgcgagaaatgttctaagcgttacgctgttcaatcggattggaaagctcactccaagacttgtggtaccaaagaatatcgttgcgactgtggtacactcttctcccggcgagatagtttcattacacatagagccttctgtgacgcgtt

SEQ ID NO: 458 - DNA, 601 bp, Brassica rapa
gggaaaagcagcaaaaaccctaattaaaaaccaaatcaaaagattaaaaaccagatcttcacgctctcttctcccgcatcaaccaactcagagagaatggatcaacaagagcatgcacagtccggagccatgaactacggctcaaacccataccaaaccaaccccatgagcaccacaagcgccggccccgcagcaccgccggggcagctgggcttccaccagatccaccagcagcagcagcagcaacagctggctcagcagctccaagtcttctgggagaaccagttcaaagagatcgagaaaacaaccgacttcaagaaccacagccttcccctcgccaggatcaagaagatcatgaaggccgacgaggacgtgcgcatgatctccgccgaggcgcctgttgtgtttgcgagggcctgcgagatgttcatcttggagctgacgctcaggtcgtggaaccacacggaggagaacaagaggaggacgctgcagaagaacgatatcgcggcggcggtgacgaggactgatatctttgacttcctggtggatattggtccgagggaggatctgagggatgaaggtcttggggagtattccgaga

SEQ ID NO: 459 - DNA, 565 bp, Brassica rapa
gaatcaacatctttcttatataattagtgaatctcaatccgtccttattacaaaaatctcccaagaaatcttacgaaacagagtctagaagacaaaacaagatgcggatgagctgtaatggatgcagagttcttcgaaaagggtgtagtgatgattgtagtatacgaccgtgyttgtcttggatcaaatcgcctgaagcgcaagcaaacgcaacggtgtttctcgccaagttctatggccgtgctggactcatgaacctcatcaacgccggtcccgatcaccttcgtcctgggattttccgatcgttgttgcatgaagcttgtgggaggattgtgaatccgatctacggttcggttggtttgttatggwcgggaaactggcagctttgccaagccgcgtggagcggtgatgaaaggtgaaccgatcacagagatggccacwgatgcsgcgaccaacggccaaggcccgccgctgaaaatgtacgacatccgacatatttccaaggatgagagctccgccgccgcagctgcggcggctactggctcaaccgatctcaaacggccga

SEQ ID NO: 460 - DNA, 516 bp, Brassica rapa
acttttctgcaaactctctttctctctctctcgcctctccggtctccttgctcttttagaatctgaataaaaataacgaccatagttgttaattactactatgaaactaagtaactgtttcttcaaccttttgttgcatggatggatcctcaacaggaaatgtcaaatgaaacattggaaaccatattggtaagctcaacaaaaggaagcaattataaaaacattaaaaaaatggaagaggaaatgaagaagaagcaaggaaaaggagaactagaaggtgaagcacaaaaatgtccaagatgtgaatctccaaacacaaagttttgttactacaacaactatagtctttctcaacctcgttacttctgcaaatcttgtcggagatattggactaaaggtggtactctccgtaacgtccccgttggtggtggttgccgtcgaaacaaacgatcttcttcatctttctccaagaacatcaataagcctatcaatttccacaacgatccacttcacaat

SEQ ID NO: 461 - DNA, 1539 bp, Zea mays
gttttgtttatatatttttgaaatggtgattctggggtttgccatgactgaatgtgattggctgcatgcgccacacagtatatctaggtggttacgacaccgaagacaaggccgcgagggcttatgatctggctgctctgaaatactggggtccagctactcacgtcaatttccccgtagaaaactaccgagatgagctcgaggagatgaaaggcatgacaaggcaagaattcgttgcgcatctgagaaggagaagcagcggattttctcgaggtgcttccatctaccgaggggtgacaaggcaccaccagcaaggaagatggcagtctcggattggaagagtcgctggaaacaaggatctatacctcggcactttcacaactcaagaagaagcagccgaggcgtacgacatagcggccatcaagttccgcggcctgaacgcggtgacgaacttcgacatagcaagatacgacgtggacaagatcatggagagcagcacgctgctggccgtggaggaagcgcgcaaggtcaaggcggtcgaggcagcgagcagtgctcctatgacgcacacgcacagcggtggcaargagcagctcaacgctaccaccgccgaggagacaagcagcgcgggctggaggatggtactccatggttctccccaccagctggaagccgcgcgttgcccagaagcagctgatctccagagcgcaatcatgaacaacgactctcatcctcgtccatccctgcatggcatcgctggactcgacatcgagtgcgcggtgcatgatcaccacgaccacctcgacgttcctgctggcagcaggacgacggctgctgggagcatcaacttctcgaactcgtcctcgcaggtgacaagcctgggaaactccagggaggggagccccgagaggctgggcttggccatgatgtacggcaagcagccgagcagcgctgtaagcctggcggccaccatgagcccctggacgccggtggcggcgcaaacagtggcacacgtgctgaagcagcagccgaacgtcgtcgtttytcatcgacctgtctttgccgcctgggcggatgcctagctacccgagggagttggagcttagtagccgctcgatcgatcttgctcgccattgctggttttttttttggtagactggagcaagattggcagcaccaggttaggtcaactagctggaatagcaaggctcgttagttagcacgatggctggtgtaatgctatgcatgcactgcagtagaagataggccttaatcagtytacagcttatgcacaatytcagtagtgctgctgctagctggtggtagctagcgttgttttgagccccttttgggtgacagattggttagaatgtagcatggcttcctttgaagaacgttgcatgaaacaaggccgttgcgagagagagagaaggaaaaggttcacgaaatgagatggctcgtctttgtttgtacgggccattcaggtctcgtcagtgggacctgcctttggctatgcgcacagatgaagatcttttgacc

SEQ ID NO: 462 - DNA, 1230 bp, Zea mays
aggagatgaagaacatgacrcggcaggagacgtggcgcacctcaggaggtacgtacgtacgtcgtttcacttcaccaaatgatcggtcatgttaatatggtacgtacaagtacggcaggaagagcagcggcttctcgcggggcgcgtccatgtaccggggagtcacaaggcaccaccagcacgggcggtggcaggcgcgcatcggccgcgtctcsggcaacaaggacctctacctcggcaccttcrgcacgcaggaggaggcsgcggaggcgtacgacgtcgcggccatcaagttccgcggcctcaacgccgtcaccaacttcgacctcacgcgctacgacgccgacaggatcatggccagcagcacgctgctgccgcccgacctcgcgcgccgcaggaaggacgacgaccccgactgcggcgtcacggccgcggctgctgccctggtgcagcaggctgctgctgctgctgccgccgcggcgccgccgccaccgccgagggacggaagccagcaccagcaccaccacgacgtgctctccggcgaggcctgcttctccgtgctgcacgacctggtggccaccgccgcggacggcggccaccaccacagcaacgcggcgcaacacgttcccgtgtccagcgcggcgtcgtcgctgctcaccagcatcggcaacggcaactaccgcgagggcagccccgaccgcggcctgtccatgctcttctccaagccgccgcctgcgcacgccgccagcgccaagccggtcagcccgctcggctcctgggcgtccacggccgcgtcggccagggccgccgtctccatcgcgcacatgcccgtgttcgccgcctggaccgacgcctgacaggccgtatcagtcgatcgatccacacgatcgagtcacatgtccatctctctcggcccgttgttggacttcttcagatctcagttagttaatttaagggattagggttcttggaaggcagcaagttaattaggtaatagctatgagagatattggttagtgatgctagtaggcgatatgatggaagggcgggagtgcgcagcgcggcctctgctgtgtttcctccttctccggcgtcgaggactgccgactgcgacgtggccggagaaggaggggttttgtaaaatgagggccggagattgacgcgcgtctcctccaaaatatatccacaactaatccactactgatgctaagttatagctctcactcaaaa

SEQ ID NO: 463 - DNA, 1539 bp, Zea mays
gttttgtttatatatttttgaaatggtgattctggggtttgccatgactgaatgtgattggctgcatgcgccacacagtatatctaggtggttacgacaccgaagacaaggccgcgagggcttatgatctggctgctctgaaatactggggtccagctactcacgtcaatttccccgtagaaaactaccgagatgagctcgaggagatgaaaggcatgacaaggcaagaattcgttgcgcatctgagaaggagaagcagcggattttctcgaggtgcttccatctaccgaggggtgacaaggcaccaccagcaaggaagatggcagtctcggattggaagagtcgctggaaacaaggatctatacctcggcactttcacaactcaagaagaagcagccgaggcgtacgacatagcggccatcaagttccgcggcctgaacgcggtgacgaacttcgacatagcaagatacgacgtggacaagatcatggagagcagcacgctgctggccgtggaggaagcgcgcaaggtcaaggcggtcgaggcagcgagcagtgctcctatgacgcacacgcacagcggtggcaaggagcagctcaacgctaccaccgccgaggagacaagcagcgcgggctggaggatggtactccatggttctccccaccagctggaagccgcgcgttgcccagaagcagctgatctccagagcgcaatcatgaacaacgactctcatcctcgtccatccctgcatggcatcgctggactcgacatcgagtgcgcggtgcatgatcaccacgaccacctcgacgttcctgctggcagcaggacgacggctgctgggagcatcaacttctcgaactcgtcctcgcaggtgacaagcctgggaaactccagggaggggagccccgagaggctgggcttggccatgatgtacggcaagcagccgagcagcgctgtaagcctggcggccaccatgagcccctggacgccggtggcggcgcaaacagtggcacacgtgctgaagcagcagccgaacgtcgtcgtttttcatcgacctgtctttgccgcctgggcggatgcctagctacccgagggagttggagcttagtagccgctcgatcgatcttgctcgccattgctggttttttttttggtagactggagcaagattggcagcaccaggttaggtcaactagctggaatagcaaggctcgttagttagcacgatggctggtgtaatgctatgcatgcactgcagtagaagataggccttaatcagtttacagcttatgcacaatttcagtagtgctgctgctagctggtggtagctagcgttgttttgagccccttttgggtgacagattggttagaatgtagcatggcttcctttgaagaacgttgcatgaaacaaggccgttgcgagagagagagaaggaaaaggttcacgaaatgagatggctcgtctttgtttgtacgggccattcaggtctcgtcagtgggacctgcctttggctatgcgcacagatgaagatcttttgacc

SEQ ID NO: 464 - DNA, 1872 bp, Zea mays
tcgacttggtgggatgtgattctccaccacctccgagcttgcaagaggcggactccacctctttcttcctcgcatgcctccttctctttccaaacacaaagccgcagcaaagaaagtgcaaattataaaggaagatcagaattcaaagcagtcgaaaagctgactagctagaagagtaaagagagagaagtatatttcagcaggacctccatggtgttcccttcagtgccagtctacctagatccacatccacctgattggaataaccagcagcagcaaggtcagcagccgagggcgagtgggggagccgatgcaccgctgttgcccgtgggtccgatggctgccacagcggcggcttcggagcccggcggcttgccgagaagctcatcaacgtccagtgccgccttggccatgcacgcaaggcccaactcgatggcggagcgcgcgcggctggcacggttaccgaatccagagccggcgctcaagtgccctcgttgtgagtccaccaacaccaagttctgctactacaacaactactccctctcccagccccgccacttctgcaagacgtgccgtcgctactggacgcgtggtggatctctccgcaacgtccccatcggcggaggttgccgccgcaacaagcgctcgtccaagtcctccgccgccgggtcttcctcctcctcaaagccgttctcctcgggtaggctgctcggtggtccatcagctatgtcgtccaccacccagggcgcaaccggtgcgatcatcgctccaggtcttagctctttctcccatcacttgccattcttgggctcgatgcacccgccaggacccaacctagggctaggcttctccgtcggattacctctgcttggcatgcaacacctggaaatggtggatcagtttccggtggcaagcggcggcggcaccaccatcggtgcatctctagagcagtggagagtgcagcagcagcagcaacaacaattcccattcatgactaggggaatactggaccttccacaaccatcgacgtaccaactgggcttggaagctagccgaggaggcagcggctcagatgcagtggcgttcactttagggcagtccacgaccagtgctgctaccataacgacaaggcaagaagggtcagcaatgaagatgggggacgatagcaaaggacaagacgcgagcttacagaagcagtacacggcagctctacaccacggatcaggatcacacggtgtttgggatgggaatgctggtggcagcggcagtggtggtggtggtggcactggcagtggcaattcaagttggccgatgaacatcgtttctgcattccattcttcgtccaccagcggtggcaatggcgatggcttatcgtagtactccagctgggggttaggccagtgtcctatcaagaatatgaagatattggagatgcatggttgagtttgagcaaatgctagctatagctaggacgatggaggaacaagagatggtcaatcagccggcctattcatcaactgctgttcctcatcagaactgtaaaaaacactgctctagctcatgatggtcacaggtaggagtttaaagtagaccctttaaagtaaggttgctctttggttaaccctttttctgccatttggttttgaacttaaaggtgttcctgcattgtatccatagcgccacttttctacttttcacaatattattgttcacagggccgggttaattaatcaaaactaatgcacggggtatattatctgataagctaataggtatatatagtatttgacatggagactgattagttgtttcatctctcgtacttgtgtgaagttggcagaaataaattaatgtatagtttgttgccaagtt

SEQ ID NO: 465 - DNA, 686 bp, Prunus dulcis
tacttttcaaattgctttgtgaggtaaagggaagaaagagaagcagggaaaagaaggaaagggtcggagaattagaaaagaagaagagataaattagatagatggctgcgtcttcttcgtcggtcgcaccgcttttcggaattagagaagaagatcaaaaccagcagatgaagcagcaacattcctctacaccgccaacctcgtccacagctgcagcagctgctccacctcagaagaaaaagagaaaccaacctggaacaccaaatccagaagcagaagtgatagcactatctcccaagaccctaatggcaacaaacaggttcatatgtgaggtatgcaacaaaggcttccaaagggagcagaacctacagctccacagaagaggacacaacctgccttggaagctcaagcagaagactacaaaagaacccaaacgcaaagtctacctgtgccccgagcccacatgcgtccaccacgacccctcccgagctctcggtgacctcaccggcatcaaaaagcacttctctagaaagcacggcgagaagaaatggaagtgcgagaagtgctccaagcgctacgccgtgcagtccgattggaggcccattctaacacttgttggactagagaatccgatgggactgtggcactctcttctcaaagagggaccagtttatcatgcaccaggc

SEQ ID NO: 466 - DNA, 605 bp, sorghum bicolor
  misc_feature (603)..(603): n is a, c, g, or t
gcacgaggctgatcttttcaaaggaggacttctgaagccctgcggagggattttgctgtttgggccacctggaaccgggaagaccatgcttgcaaaggctatagcaaatgacgccggggccagcttcatcaatgtatcgatgtccaccatcacatccaaatggtttggggaggatgagaaaaatgtccgggcattgttcagtttggctgccaaggtagctcccactatcatttttgtggatgaggtagacagcatgttggggcagcgcgctcgctacggtgaacatgaggccatgcggaagatcaagaacgagttcatgagtcactgggatggtctcttgtcaaaaacaggtgaaagaattcttgttcttgccgcgacaaataggccgtttgaccttgatgaagccatcatcaggagatttgagcgcagaatcatggttgggcttccaactcaagagagcagagagctgatcttgaggacactactgtcaaaagagaaaattgaggaaaatattgatttcaaggaacttgcgaccatgacggagggatacagtggcagtgatctcaagaatctctgtgtcactgctgcttaccgccctgttangg

SEQ ID NO: 467 - DNA, 1227 bp, sorghum bicolor
actactagacaagcttgaagggccagtgttagtcctcggatcaaggattgtagatatggacagtgatgaggagttagatgacagattgactgttctgttcccatataatatagaaatcaagccacctgaaaacgaaaaccaccttgtaagttggaactcccaattagaagaagacatgaagatgattcagtttcaagataaccgaaatcatattatggaagtccttgcagaaaatgatcttgaatgtgatgatttaggctcgatttgcctatctgatactatgtgccttagtaagtatatagaagagattgtggtgtctgcggtttcatatcacttgatgaataacagagatccagagtaccgaaatgggaaattagttctatccacaaagagcttgtcccacgcattggaaatttttcaaggcaacaagatgggcgataaggacagcatgaaattggaagtgacggatggtgctttaaaggctgctgaaaaggcaattgctccagccactgcaaaatcagaaacaaaacctgcaacgttgctgccaccagttcgacctccggctggtgctgctgctgctgctccctccagtgcccctgctcctagagttgagagcaaaacagaaccggagaagaaggataatccacctccagttgcaaaagcactggaagtgccaccagataatgagtttgaaaagcgcattagaccagaagtgatacctgctaatgaaattggagtttcatttgatgatattggtgccttggatgatatcaaagaatcccttcatgagcttgtcatgctgcctcttagacgacctgacctcttcaaaggcggtcttcttaagccctgcagaggtatattactttttggtcctccaggaaccggcaagactatgcttgccaaggccatagcaaatgaagctcaagcaagttttataaatgtctctatgtcgactatcacatcaaagtggtttggtgaagacgaaaagaatgttcgagcattgttcacattagctgctaaagtatcaccaaccatcatctttgtcgatgaagttgatagcatgcttgggcagcggaacagagctggagagcacgaggcaatgagaaagatcaagaatgaatttatgacacactgggatggactcttgtcaagaccagatcagagaattcttgttcttgctgcgactaaccggccttttgatcttgatgaggctatcatccgtaggtt

SEQ ID NO: 468 - DNA, 710 bp, sorghum bicolor
caggcatcaccagcacgggagatggcaagccaggattgggagggtcgctggcaacaaggacttgtatcttggcacgttcagcacgcaggaggagtcggcggaggcgtacgacatcgcggcgatcaagttccgtggcctcaacgcggtgaccaacttcgacatcagcaagtacgacgtgaagcgcatctgcgccagcacccacctcatcggcggcggcgacgcgtgcaggcgctccccgacgcagccgccggacgcgccggcgctcgccatcgacgctgctggcgccgaccggtcgtcgcacgcgccgggcggcggcgaccaggccgtgtccgacaactcggacacctccgccggacaccgcggcgcgcacctgctgcacggcctccagtacggccaccccatgaagctggaggccggcgagggcagcagctggatggcggcggcgacggcggcggcggcgcggccggtggcaggcgtgcaccagctaccggtgttcgcgctgtggaatgactgttgattgtggcaaccaaccgcgcgcgtagagcacgtagtagtagtcgtagttagtgaagaaatgcatggcactgcacctgcatgcacgaggtgtaagtgtaacgacgacttcggcagtagtaggggcggtgaagaagcgacgaacagctgaactttttgtgacggacctctgcaagccagatgcatgttgcacgctc

SEQ ID NO: 469 - DNA, 495 bp, Glycine max
tccttgctgtgacaaagttggcatcaagaaaggtccatggacacctgaggaggatatcatccttgtctcttacatccaagaacatggtccaggaaattggagatcagtgcctactaatactgggttatcaaggtgcagcaaaagttgcaggcttagatggacaaattacctcaggccaggaatcaagagagggaacttcactccccatgaggaaggaatgataattcacttgcaagctctactgggtaacaagtaattctcaaatatcataattttctttagttttctcaacaaagttaaagagatcaatcaataccatgataattaaagttcacatacttttcattgattaattttgacaaaaaaataactttttaatctataattttagcatatgatatgcctgaatttgtgaagttgttgacttttggagcagatgggcagccatagcttactatcttccacaaagaacagacaatgacataaagaattatt

SEQ ID NO: 470 - DNA, 1578 bp, Glycine max
tggggaacaaccacaacaacaaattttccaattagccactatgagaaagagttggaagaaatgaagcacatgactaggcaagagtacgttgcgtcattgagaaggaagagtagtgggttttctcgcggtgcatccatttatcgaggagtgacgagacaccaccaacatggaaggtggcaagcgaggattggaagagttgctggcaacaaggatctttacttgggaacttttagcacccaagaagaggcagcggaagcatatgatgtagcagcaatcaaattccgaggactaagtgctgttacaaactttgacatgagcagatatgacgtgaaaagcatacttgagagcaccactttgccaataggtggtgctgcaaagcgtttgaaggatatggagcaggttgaactgagtgtggataatggtcatagagcagatcaagtagatcatagtatcatcatgagttctcacctaactcaaggaatcaataacaactatgcaggagggggaacagcaactcatcataactggcacaatgctcatgcattccaccaacctcaaccttgcaccaccatgcactacccttatggacaaagaattaattggtgcaagcaagaacaacaagacaactctgatgcccctcactctttgtcttattcagatattcatcaacttcagctagggaacaatggaacacataacttctttcacacaaattcagggttgcaccctaatgttgagcatggattctgcttccattgacaatagctattcatcaaacacagctagggaacaagggcacacacaacgtcgggcacacaaagtcatgcctatgggaactactactgctgttgttgcaagtgatggtgatcaaaatccaagaagcaatcatggttttggtgataatgagataaaagcacttggttatgaaagtgtgtatggctctgcaactgattcttatcatgcacatgcaaggaacttgtattatcttactcaacagcaatcatcttctgttgatacagtgaaggctagtgcatatgatcaagggtctgcatgcaatacttgggttccaactgctattccaactcatgcacccagatcaactactagtatggctctctgccatggggctactacacccttctctttattgcatgaataggtggaaaactagggagagaaggaagagtcaaaaaggtgatgaagaagatgcatatattgctgacttgtttcttcctcttgtgaagttgctaatttgatagtgtgcacttttgaagatgaggatatataggatttctttcactatctctaacttgcaggatccttatttcactagggtctaagtaatctagcctcaagtttagtcatggcagaagcatttgctgtgaattttgggaattaactttggagaatgtgtggacagatcattgggatgtttttattatcagcggactttttaattctggaataacaacgatcataccaagggtggagttttcctcaatgtatatgcatggcacttgtttttagttttttaaccaaattctttttatacattatgcatggtaatgggtgttagtg

SEQ ID NO: 471 - DNA, 998 bp, Glycine max
  misc_feature (862)..(864): n is a, c, g, or t
ggaaaaagctgcgagagcttatgatctagcggcactcaagtattggggaccctccactcacataaactttcctttggaaaattatcaaaatgaacttgaggaaatgaagaacatgactagacaagagtatgttgctcatttgagaagaaaaagcagcggattctcaagaggggcttccatgtacagaggagtaacaagcagacaccaccaacatggaaggtggcaagctcgaattggtagagtggctggaaacaaagatctatatcttggaacctttagtacacaagaggaagcagctgaagcctatgatattgctgctataaaattccgaggagcgaatgctgtaaccaactttgacataacaagatatgatgtggagaaaatcatggcaagcagcaacctccttagcagtgagctagctaggcgcaaccgagagacggacaatgaaactcagtgcattgatcaaaatcacaataagccttctgcatatgaggacactcaagaagctattctaatgcaccagaagagctgtgagagcgaaaatgatcagtggaagatggttctctaccaatcctctcagcaacttgagcagaatccaccaacaattgagagtgacagaactaaccagtccttcgcagtggctttggacagcatgtttcatcaggaagtagaggaatcaagtaaggtgaggacgcatgtgtcaaatccttcttcattggccacaagtttgagcagctcaagagaaggtagccctgataggacaagcttgccaatgctctctggaatgccttcaactgcatcaaaactattggctactaatccaaataacgtgaattcttgggacccttcaccccatttgagnnnagcacttactttgcctcaaatgccagtttttgcagcttggacagatgcatagttcatagctcaatagtccttttaattttttgttctctcaagtgaaatttcaatcctttttattgtctttttttgcatgcatg

SEQ ID NO: 472 - DNA, 1583 bp, Glycine max
tggggaacaaccacaacaacaaattttccaattagccactatgagaaagagttggaagaaatgaagcacatgactaggcaagagtacgttgcgtcattgagaaggaagagtagtgggttttctcgcggtgcatccatttatcgaggagtgacgagacaccaccaacatggaaggtggcaagcgaggattggaagagttgctggcaacaaggatctttacttgggaacttttagcacccaagargaggcagcrgaagcatatgatgtagcagcaatcaaattccgaggactaagtgctgttacaaactttgacatgagcagatatgacgtgaaaagcatacttgagagcaccactttgccaataggtggtgctgcaaagcgtttgaaggatatggagcaggttgaactgagtgtggataatggtcatagagcagatcaagtagatcatagtatcatcatgagttctcacctaactcaaggaatcaataacaactatgcaggagggggaacagcaactcatcataactggcacaatgctcatgcattccaccaacctcaaccttgcaccaccatrcactacccttatggacaaagaattaattggtgcaagcaagaacaacaagacaactctgatgcctctcactctttgtcttattcagatattcatcaactacagctagggaacaatggcacacacaacttctttcacacaaattcagggttgcaccctatgttaagcatggattctgcttccattgacaatagctcttcatctaactctgttgtttatgatggttatggaggtggtgggggctataatgtgattcctatggggactactactactgttgttgcaaatgatggtgatcaaaatccaagaagcaatcatggttttggtgataatgagataaaggcacttggttatgaaagtgtgtatggttctacaactgatccttatcatgcacatgcaaggaacttgtattatcttactcaacagcaaccatcttctgttgatgcagtgaaggctagtgcatatgatcaagggtctgcatgcaatacttgggttccaactgctattccaactcatgcacccagatcaactactagtatggctctctgccatggggctactacacccttctctttattgcatgaataggtggaaaactagggagagaaggaagagtcaaaaaggtgatgaagaagatgcatatattgctgacttgtttcttcctcttgtgaagttgctaatttgatagtgtgcacttttgaagatgaggatatataggatttctttcactatctctaacttgcaggatccttatttcactagggtctaagtaatctagcctcaagtttagtcatggcagaakcaatttgctgtgaattttgggaattaactttggataagaatgtgtggacagatatcattgggatgtttttattatcagcggactttttaattctggaataacaacgatcataccaagggtggagttttcctcaatgtatatgcatggcacttgtttttagttttttaaccaaattctttttatacattatgcatggtaatgggtgttagtg

SEQ ID NO: 473 - DNA, 1522 bp, Glycine max
attattaggtggttatgataaggaagaaaaagcagcaaaggcttacgacttagctgcactcaagtattggggtccaacaactcacataaatttccctttaagcacttatgagaaggaacttgaagagatgaagcacatgaccaggcaagaatttgtcgccaatttaagaaggaagagcakcggattttcaagaggggcatctgtgtatagaggtgtgacaaggtatggactaaagtgatgtgtgctttaacattaatatgattaaagttttccatgaattattttctgcaactctcagctttttaattaaggtgggcaattattggccaacgtttgtctttttctccttgtatcatttcagacaccatcaacatggaaggtggcaggcccgaataggaagggttgcaggaaacaaggacttgtatcttggtacatttagcacacaagaagaagctgctgaagcatatgatatagcagcaatcaagttcaggggaacaagtgctgtgaccaactttgacataagtaggtatgatgtgaagagaatctgctcaagctccactctcattgcaggagatcttgcaaaacggtctcctaaagaatcaccagctctggttcctgccgaggacttcaattcgtgtggttcatcgatgccgcyggyrtctcagccmcctcctttggctataactgatggtgaacattctgatgagttgtccaacatgatgtggaatgccaacaacagygatgwgcawgcacagaatgagagtgrtggtgctgaacwtcaacaacaatgtmactgaatcatcatcatcacaacaggtttcaccaagcagcaacaaggatgctttgaaccctcaaagccccaagtgttctgtggggctacccaatgagtttggagtcagtggagcagattatggacatggctacttcacccttgatggaccaaaatatgatgatgggaacaatgaaaatgaccacatgagcaccaacaggcttggaaatttgggattggttaatcaagttcccatgtttgctttgtggaatgaatgaagggaatgttatgttgatgagttgagattacaaaaaacatttagcttaggaaaaaaaactaagatcagatggcagaattattgaatgattattatattgtagcttggtatggtaactttttattttatgttgaaagaaaggggatatgtcagtagtgctgattcctgaagtaaaaagagcagataatgaaaataggtacttcacccttgaagaaaaaaaaaaggatgatgggaacaatgaaaacgaccacatgagcaccaacaggcttggaaatttgggattggttaatcaagttcccatgtttgctttgtggaacgaatgaagggaatgttatgttgagttgagattacaaaaaacattagcttagttagggaaaaaaaaaactaagatcagatggcagaattattgaatgattattattgtagcttggcatggtaacttttattgtatgttgaaagaaaggggatatgtcagt

SEQ ID NO: 474 - DNA, 383 bp, Glycine max
attattaggtggttatgataaggaagaaaaagcagcaaaggcttacgacttagctgcactcaagtattggggtccaacaactcacataaatttccctttaagcacttatgagaaggaacttgaagagatgaagcacatgaccaggcaagaatttgtcgccaatttaagaaggaagagcagcggattttcaagaggggcatctgtgtatagaggtgtgacaagacaccatcaacatggaaggtggcaggcccgaataggaagggttgcaggaaacaagacacaccctttaggagagacccacaacatatcaatcccgcatgattatatgactatgatacaccttcagaggggtgaaaaaagaaatggaaaatataaataaatag

SEQ ID NO: 475 - DNA, 742 bp, Glycine max
ggaaaaagctgcgagagcttatgatctagcggcactcaagtattggggaccctccactcacataaactttcctttggaaaattatcaaaatgaacttgaggaaatgaagaacatgactagacaagagtatgttgctcatttgagaagaaaaagcagcggattctcaagaggggcttccatgtacagaggagtaacaagcagacaccaccaacatggaaggtggcaagctcgaattggtagagtggctggaaacaaagatctatatcttggaacctttagtacacaagaggaagcagctgaagcctatgatattgctgctataaaattccgaggagcgaatgctgtaaccaactttgacataacaagatatgatgtggagaaaatcatggcaagcagcaacctccttagcagtgagctagctaggcgcaaccgagagacggacaatgaaactcagtgcattgatcaaaatcacaataagccttctgcatatgaggacactcaagaagctattctaatgcaccagaagagctgtgagagcgaaaatgatcagtggaagatggttctctaccaatcctctcagcaacttgagcagaatccaccaacaattgagagtgacagaactaaccagtccttcgcagtggctttggacagcatgtttcatcaggaagtagaggaatcaagtaaggtgaggacgcatgtgtcaaatccttcttcattggccacaagtttgagcagctcaaga

SEQ ID NO: 476 - DNA, 1231 bp, Glycine max
gatacctttgggcaaagaacatctcaatatagaggtgtaacaaggcataggtggactggtagatatgaagctcatctatgggacaacagctgcaagaaagagggccaaggaaggaaaggaaggcaagtttatctagggggttatgatatggaagaaaaagcagcaagagcttatgatatggccgcactcaagtattggggaccctcctctcatataaatttcccattggaaaattatcaaaacgaacttgaggaaatgaagaacatgacgagacaagaatatgttgctcatttacgaaggaaaagcagcggattctcaagaggggcctccatgtacagaggagtaacaaggcaccaccaacatggaaggtggcaagctcgaattggaagggtagccggaaacaaagatctatatcttggaacctttagtacccaagaggaagcagctgaagcctatgacattgctgctattaaattcagaggagttaatgctgtcactaactttgatataacaagatatgacgtggaaaaaattatggagagcaataaccttcttagcagtgaacaagctaagcggaaaagagagatggatgatggaactagaagcgaggctaccgttaaccaaaaaccttctacatatgaccacactcaagaaaccattctaatgcagaaaagatgcaaaaaccaatcagaatggaagatggttcagtttccatgcccccaacagcttgatcagaatcaaagaatcgagagttgtagaactcagcccttctcaacggacttagataacatgtttcgtcaccaagttgaggaacggagcaacatgggaacacacttgtcaaatccttcttctctggtgacaagtttgagtagctcaagagaagagagcccagataagacaagcatgccaatgctctttggaatgccttcaacagtgtccaaattattggctaacgtggattcttgggatctatcttccaatctcaggactgcgctttctatgcctcagatgccaatttttgctgcttggacagatgcataatcttatgttttttacctctatcaaaatagcaaatgcttgtttactaaaacaggatgttaatgcctagctagtacaatagagagcttgtgcggaattttaaaatgttaactgttacatcaagcattttcctcgtacaatgagaggaaagctcctaaagttttatatcctaggactccaaattcgtatcatc

SEQ ID NO: 477 - DNA, 1193 bp, Glycine max
gtaaaattgtgtgtgcatatgtgttggtgtatctgcatgacaccaaatcagtggaagatactcacaaaacctctacctcgaactttctcatttacggacgcgtgggcttgggagaaaaattcatatcaagtggccatgatgggggttgatttaattttccttttttcttcctctctcttcatctcctatatctctcttctctgcttcaaaaaaattttcaagaaaaaaatttccctttattagtttctcttctctacttctctgttaggttcaagagaatccaaattcccttgcctttgagttttgagattggggataagaattgagaaggactcaaactgcacgtgggtttttcagaattctgatttaggtgtaaggtttcaaatacaagaaggaaaagaaacactttgagaagaaggttaattatacatagaggtttttttttataagatatggcagcacctttttctgcagcatcgctctttgcaatcagagaagaggatcagaatcagatgaagcagcagcattcctcaacaccatcatcatcaaccactccagctgcaccaccaccccagaagaaaagaagaaaccaaccaggaacaccatatccagatgctgaggtgatagcactatctcccaagactctaatggcaacaaacaggtttttatgtgaagtgtgcaataaagggttccaaagagagcaaaacctacagctgcacagaagaggacacaacttgccttggaagctaaagcaaaagaccaacaaagagccaaagagaaaggtttatctgtgtsccgagcccacatgtgtwcaccatgacccttcaagagcccttggagacctcactggcattaagaaacactactctcgcaaacatggtgagaagaagtggaagtgtgataagtgctccaagaaatatgctgttcaatcagattggaaggcacactccaaaacctgtggcactagagagtatagatgtgactgtggcaccctcttctccaggcgtgacagtttcatcactcatasggcattttgtgatgctctagcacatgagagtgcaagacacccttcaagcgtgaatcatttgggaactcatcatctgtatggcacaaaccacatgagcctaggccttggtgctcaacttcagaaccaccaaatctcagccactaacagcatattgagccttggaagc

SEQ ID NO: 478 - DNA, 1414 bp, Glycine max
gtaaaattgtgtgtgcatatgtgttggtgtatctgcatgacaccaaatcagtggaagatactcacaaaacctctacctcgaactttctcatttacggacgcgtgggcttgggagaaaaattcatatcaagtggccatgatgggggttgatttaattttccttttttcttcctctctcttcatctcctatatctctcttctctgcttcaaaaaaattttcaagaaaaaaatttccctttattagtttctcttctctacttctctgttaggttcaagagaatccaaattcccttgcctttgagttttgagattggggataagaattgagaaggactcaaactgcacgtgggtttttcagaattctgatttaggtgtaaggtttcaaatacaagaaggaaaagaaacactttgagaagaaggttaattatacatagaggttttttttttataagatatggcagcacctttttctgcagcatcgctctttgcaatcagagaagaggatcagaatcagatgaagcagcagcattcctcaacaccatcatcatcaaccactccagctgcaccaccaccccagaagaaaagaagaaaccaaccaggaacaccatatccagatgctgaggtgatagcactatctcccaagactctaatggcaacaaacaggtttatatgtgaagtgtgcaataaagggttccaaagagagcaaaacctacagctgcacagaagaggacacaacttgccttggaagctaaagcaaaagaccaacaaagagccaaagagaaaggtttatctgtgtgccgagcccacatgtgttcaccatgacccttcaagagcccttggagacctcactggcattaagaaacactactctcgcaaacatggtgagaagaagtggaagtgtgataagtgctccaagaaatatgctgttcaatcagattggaaggcacactccaaaacctgtggcactagagagtatagatgtgactgtggcaccctcttctccaggcgtgacagtttcatcactcatagggcattttgtgatgctctagcacatgagagtgcaagacacccttcaagcctgaaccctttgggaactcatcatttgtatggcacaaaccacatgagcctaggccttagtgctcagcttcagaaccaccaagcagctactaacagcatattgagccttggaagtgcaccaaagtttgagcacttaatctcaccaaatctgcaccactcaccatcatcatttggagtgcaatcaccaccaccaccaccccagtcatcatcattcttcatgactgatccaaaccaagcatttcaagacctccaatctcagaaccaaggacacttattctcaaacaagcaacttcatggtctcatgcaactccctgatcttcaaggaaccaccaatatca

SEQ ID NO: 479 - DNA, 1817 bp, Glycine max
tcagaaatgcactctctctctttctctctccagaacacaactcaacacactcttcaatttcaaacgcacactcttcaacttcactgtgcctccctttttaattgaaaccaaaccaaaccaaaccaraccaaacctctctttctcagtttctctctcttagggttttctcctcccccattgacccaccgtccatcgcawssraacrrmcckmgctttctcagtttctctttcttagggttttctccaccgtccattgcaaagtcttgcgcccaatttccatggaactgtaaagagaggatagttagaagattaaatcttaaagcagtaagtcatcatggataaatcagagcagactcaacagcagcagcagcaacaacagcatgtgatgggagttgccgcaggggctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattrgtgrrttctccagctgatatgccatattactatgtccctccacagcatcctgttgtaggaccwcctgggatgatcatgggcaagcccgttggtgctgagcaagcaacgctrtattctacacagcagcctcgacctcctatggcgttcatgccatggcctcatacacaacccctgcaacagcagccaccccaacatcaacaaacagactcatgatgactatgcaattcaattaggttggaaagtagcctgcaccttttgattattacaaatttacttaatgcctttcagccagctgtagtttagtgttgtgcattgaaaaaaagcaaaagattgttttgaggtttcttgcactcatttatgattgtatgagctcttrtgmtgagttacttttggttgtgtttatytgaggtactggtgtrgtrgttaaattagtttggcagctgtccataaccagagagcgtagctgcttaattaggaggtctgaaatgatgaaatagtttgtattgttattgcagaaggtaggttttattcagtatttcattctactgcaatggctgaatttattgctcatctgcatagtactagttgatgttttttcctgtsactcgttatgtgttgagtgtgaagaaaaattagtgtgccatttttcacctgtaaatgcacactacagccccggaagaacaaattgttccgatcattttcaattttttttcccggtaacatgaaaagtggttgatgttaaatgctgtccctgtaaaaaaaaaaaaaaaagaattgacagcaggaaaaaaaaaataacgagctgttctttttcttgattcaaaaccacataaatatatccagattagttttatagttaataattgattttattcggaag

SEQ ID NO: 480 - DNA, 1553 bp, Glycine max
cacgcgtccgcctctctttctagtttctctctcttagggttttctcctcccccattgacccaccgtccatcgcaaaggaagtcgcgcccaatttccatggactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgacaatgcaattcaattaggtcggaaagtagcatgcaccttatgattattacaaatttacttaatgcctttaagtcagctgtagtttagtgttttgcattgaaaaatgccaaagattgtttgaggtttcttgcactcatttatgattgtatgagctcttatgctgagttacttttggttgtgtttatttgaggtactggtgtggtagttaaattagtttgtagctgtccataagtaaacagcgtagctgcttaattaggaggtctgaaatgatgaaatagtttgtattgttattgcagaaggtaggttttattcagtatttcattttactgcaatggctgaatttattgctcatccgcttagtactagttgatgttttttcctgtcactcgttatgtgttgagtgtgaagaaaaattagtgtgccatttttcacctgtaaatgcacactacagccccggaagaacaaattgttccgatcattttcaattttttttcccggtaacatgaaaagtggttgatgttaaatgctgtccctgtaaaaaaaaaaaaaaaagaattgacagcaggaaaaaaaaaataacgagctgttctttttcttgattcaaaaccacataaatatatccagattagttttatagttaataattgattttattcggaag

SEQ ID NO: 481 - DNA, 1443 bp, Glycine max
tcagaaatgcactctctctctttctctctccagaacacaactcaacacactcttcaatttcaaacgcacactcttcaacttcactgtccctccctttttaattgaaaccaaagcaaacctcgctttctcagtttctctttcttagggttttctccaccgtccattgcaaagtcttgcgcccaatttccatggaactgtaaagagaggatagttagaagattaaatcttaaagcagtaagtcatcatggataaatcagagcagactcaacagcagcagcagcaacaacagcatgtgatgggagttgccgcaggggctagccaaatggcctattcttctcactacccgactgcttccatggtggcttctggcacgcccgctgtaactgctccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccatagccttcctcttgctcggataaaaaagataatgaaagctgatgaagatgtccggatgatttcagcagaagctccggtcatatttgcaaaagcttgtgaaatgttcatattagagttgacgttgcgatcttggatccacacagaagagaacaagaggagaactctacaaaagaatgatatagcagctgctatttcgagaaacgatgtttttgatttcttggttgatattattccaagagatgagttgaaagaggaaggacttggaataaccaaggctactattccgttagtgggttctccagctgatatgccatattactatgtccctccacagcatcctgttgtaggaccacctgggatgatcatgggcaagcccattggcgctgagcaagcaacactatattctacacagcagcctcgacctcctgtggcgttcatgccatggcctcatacacaacccctgcaacagcagccaccccaacatcaacaaacagactcatgatgactatgcaattcaattaggttggaaagtagcctgcaccttttgattattacaaatttacttaatgcctttcagccagctgtagtttagtgttgtgcattgaaaaaaagcaaaagattgttttgaggtttcttgcactcatttatgattgtatgagctcttgtgatgagttacttttggttgtgtttactattggtgtagtggttaaattatttggcagctgtccataaccagagagcgtagctgcttaattaggaggtttgatatgatgaaatagtttgtattgttattgcagaaggtaggtttaattcagtattccattctactgcaatggctgaatttattgctcatctgcatagtactagttgatgttttttcctgtg

SEQ ID NO: 482 - DNA, 1561 bp, Oryza sativa
gcatagatggacagggcgatatgaggctcatctctgggataatagctgtagaagagaagggcagagtcgcaagggtaggcaagtwmtcwggtggctatgacaaggaggataaagcagcgagagcttatgatttggcagctctgaagtattggggcacaacaacaacaacaaatttcccaataagtaactatgaaaaagagctagatgaaatgaaacatatgaccaggcaggagtatattgcatacctaagaaggaatagcagtggattttctcgtggtgcatcgaaatatcgtggtgtaaccaggcaccatcagcatgggagatggcaagcaaggatagggagggttgcaggaaacaaggacctctacttaggcaccttcagcaccgaggaggaggcggcggaggcgtacgacatcgcggcgatcaagttccgggggctcaacgccgtcaccaactttgacatgagccgctacgacgtcaagagcatcctggagagcagcacgctgccggtgggcggcgcggcgaggcggctgaaggaggcggcggaccacgcggaggcggccggcgccaccatctggcgcgccgccgacatggacggcgccggcgtcatctccggcctggccgacgtcgggatgggcgcctacgccgcctcgtaccaccaccaccaccaccacggctggccgaccatcgcgttccagcagccgccgccgctcgccgtgcactacccgtacggccaggcgccggcggcgccgtcgcgcgggtggtgcaagcccgagcaggacgccgccgtcgctgccgccgcgcacagcctccaggacctccagcagctgcacctcggcagcgccgccgcccacaacttcttccaggcgtcgtcgagctcgacggtctacaacggcggcggcggcgggtaccagggcctcggtggcaacgccttcttgatgccggcgagcaccgtcgtggccgaccaggggcacagcagcacggccaccaaccatggaaacacctgcagctacggcaacgaggagcaggggaagctcatcgggtacgacgccatggcgatggcgagcggcgccgccggcggcgggtaccagctgtcgcagggctcggcgtcgacggtgagcatcgcgagggcgaacggctactcggccaactggagctcgcctttcaatggcgccatgggatgatcgatgaagaggagcaacaggagctagtatagctaattaggggatcgatcgattaattaagctagatcaagtcaagtttaggttagacgaatcttgatcacggttgtgttgcaactcgtttggtcgttgatcaggttttgcttgactgggtgtgagtgacacacacgcaaggtgctgccttccggaagctgggtaatggcaggtaagggtataagctagtaaagtttgtgttgtaacttctaagttaatatccttgcttgctgttagttttgggtatagtttcagaaggatcatgccaatcctcagaggagatacacactaattaatctcgtgcaatgacaataactccatcataatatcttggcgctcatacttta

SEQ ID NO: 483 - DNA, 364 bp, Oryza sativa
cccttaaatactggggcactacaacgacgacgaattttccggtaagcaactacgaaaaagagttggatgaaatgaagcacatgaataggcaggaatttgttgcatcccttagaagaaaaagcagtggattttcacgtggtgcttccatatatcgtggtgttacaagacaccatcagcatggaaggtggcaagcaaggataggacgggtggcaggaaacaaggatctgtatttgggcacatttggcacccaagaggaagctgcagaggcatatgatatcgctgcaatcaaattccgtggtctcaatgctgtgacaaactttgacatgagccggtacgatgtcaagagcatcattgaaagcagcaa

SEQ ID NO: 484 - DNA, 2755 bp, Oryza sativa
gcatcatgcatatctatcttatataaatatctaccagtgatactgttgcttagtgctccaaacctctcttgacctcttcttcttcttctcagttagcttagcttaagcttcccctaaccttgagctcaccacaacaatggcgacttgatctaacagagcttaaccaagtagcaaatcatacatataaccatagcttaattcgcattgaatcttgtcttgttcagtgtgaatcatcaaccatggccaccatgaacaactggctggccttctccctctccccgcaggatcagctcccgccgtctcagaccaactccactctcatctccgccgccgccaccaccaccaccgccggcgactcctccaccggcgacgtctgcttcaacatcccccaagattggagcatgaggggatcggagctctcggcgctcgtcgccgagccgaagctggaggacttcctcggcggcatctccttctcggagcagcagcatcatcacggcggcaagggcggcgtgatcccgagcagcgccgccgcttgctacgcgagctccggcagcagcgtcggctacctgtaccctcctccaagctcatcctcgctccagttcgccgactccgtcatggtggccacctcctcgcccgtcgtcgcccacgacggcgtcagcggcggcggcatggtgagcgccgccgccgccgcggcggccagtggcaacggcggcattggcctgtccatgatcaagaactggctccggagccagccggcgccgcagccggcgcaggcgctgtctctgtccatgaacatggcggggacgacgacggcgcagggcggcggcgccatggcgctcctcgccggcgcaggggagcgaggccggacgacgcccgcgtcagagagcctgtccacgtcggcgcacggagcgacgacggcgacgatggctggtggtcgcaaggagattaacgaggaaggcagcggcagcgccggcgccgtggttgccgtcggctcggagtcaggcggcagcggcgccgtggtggaggccggcgcggcggcggcggcggcgaggaagtccgtcgacacgttcggccagagaacatcgatctaccgcggcgtgacaaggcatagatggacagggaggtatgaggctcatctttgggacaacagctgcagaagagagggccaaactcgcaagggtcgtcaaggtggttatgacaaagaggaaaaagctgctagagcttatgatttggctgctctcaaatactggggcccgacgacgacgacaaattttccggtaaataactatgaaaaggagctggaggagatgaagcacatgacaaggcaggagttcgtagcctctttgagaaggaagagcagtggtttctccagaggtgcatccatttaccgtggagtaactaggcatcaccagcatgggagatggcaagcaaggataggaagagttgcagggaacaaggacctctacttgggcaccttcagcacgcaggaggaggcggcggaggcgtacgacatcgcggcgatcaagttccgggggctcaacgccgtcaccaacttcgacatgagccgctacgacgtcaagagcatcctcgacagcgctgccctccccgtcggcaccgccgccaagcgcctcaaggacgccgaggccgccgccgcctacgacgtcggccgcatcgcctcgcacctcggcggcgacggcgcctacgccgcgcattacggccaccaccaccactcggccgccgccgcctggccgaccatcgcgttccaggcggcggcggcgccgccgccgcacgccgccgggctttaccacccgtacgcgcagccgctgcgtgggtggtgcaagcaggagcaggaccacgccgtgatcgcggcggcgcacagcctgcaggatctccaccacctcaacctcggcgccgccgccgccgcgcatgacttcttctcgcaggcgatgcagcagcagcacggcctcggcagcatcgacaacgcgtcgctcgagcacagcaccggctccaactccgtcgtctacaacggcgacaatggcggcggaggcggcggctacatcatggcgccgatgagcgccgtgtcggccacggccaccgcggtggcgagcagccacgatcacggcggcgacggcgggaagcaggtgcagatggggtacgacagctacctcgtcggcgcagacgcctacggcggcggcggcgccgggaggatgccatcctgggcgatgacgccggcgtcggcgccggccgccacgagcagcagcgacatgaccggagtctgccatggcgcacagctcttcagcgtctggaacgacacataaaaaaaaaactaggttagccagcttaattagcagggtaaaccactgacacaattaagccatacttaaattagggttcatgagatgaccattaagcaggttattatcattaatgatgtttaatttctcaattagtacttagctcaaaaggaggggatttcttctgaaggatggtgatggcttgtgaaattgaacctggtgttcttgccatgatttttttttcacaagctgccattttggggttcaggttcagaaggatcctgattattattaaccagccatatatatatagaagggtagaaatggaggtatcctgcttgtaaattggggcaatggtagctagagttgatgcaatgaccatgcttcatgtgatgagaactaattgtcttcctctgatcaaattaagcaggaagattaagcaaagctcaatattgtttcag

SEQ ID NO: 485 - DNA, 491 bp, Helianthus annuus
gggagatgccatacggatacccaccacaaaatcaaatgatggggcccggcccgccagcaggtcaatccgcacagtctgtcggtcatccttcacctccagctcagctcgcacaacagcaactcgcctaccagcacatccatcagcaacagcagcagcaactgcatcaacagcttcaaaacttctgggcaaatcaataccaagaaatcgaacaaacaaccgattttaaaaaccacagtctaccattagccaggatcaagaaaatcatgaaggctgatgaggatgtaaggatgatatcagctgaagccccggtcatattcgcacgcgcgtgtgaaatgtttatccttgagttgactctaaggtcttggaaccacactgaagagaacaaaaggaggacgcttctgaaaaacgatattgcggctgcgatcacaaggactgatatctttgactttttggttgatatagtaccacgagaggatttaaaggatgaggtg

SEQ ID NO: 486 - DNA, 304 bp, Helianthus annuus
cagtgagggtcaaggtgtggctgatgttttgtatggtgattatggttttacgggtaagcttgcgcgtacgtggttcaagacggttgatcagttgccgatgaatgtgggtgacccgcattatgacccgttgtacccgtttggattcgggattactactgaaccggttaaatcaagttagaggttaattattgttttagatttgaagatgtgtatttaatgtgtttttaggaattaaggttttgcatttggttactgggtgcctgttttttattctctagtatatgcaaataatgttttttttagg

SEQ ID NO: 487 - DNA, 463 bp, Populus trichocarpa
gtctcacctctaaaatcaaccaccagcaacaagtcttctccttgttagaaaagaggaacacctgcatctcacacagagagaccaaaacaatgacaacttcgaagcgcctttccgagaggaaagtggcaaagtttcacaagaatatcactaagagaggatctgttcctgaaacttcgacaaagaaaggatatgactacccagttgggccaatactacttggattctttgtctttgtggtaattggatcatctctttttcagataatcaggacagcatctagtggtgggatggcctaaggtactggagttatgtttatgatggaaatctgcagcattgtaatgagctagggctttactatcaaaatgtaaagttagaacacgtgtgaaagttctaatgcaaaatgatgaataaattgtgttctctaccaccagttttgtacagtgttccgttttccaagttttcg

SEQ ID NO: 488 - DNA, 1722 bp, Populus trichocarpa
tatccaggaagcaggagggaatgagactgttgctgcgaaaccagaaacaaaagctgaaggcgcaaatccagaaaataaaagtgaagtagagaaaaaggcttcaggggttaaggcagttggtgaaaattccttaccatcatcaaaagctccggaagttcctcctgacaatgaatttgaaaaacgcataaggccagaggtgatacctccgaatgagattaatgtaactttttccgacatcggtgccttggaagagaccaaagaatcgcttcaggaactagtgatgcttcctcttcgcagaccagacctctttaaaggaggactgctaaagccttgcaggggaattttgctttttggccctcctggaactgggaagacaatgctggcaaaagctattgctaaagaagctggagccagcttcatcaatgtatctatgtcaaccattacttccaaatggtttggtgaagatgagaagaatgtccgagctttgttcacactggcagcaaaggtttccccaactattatatttgtagatgaggttgatagcatgcttgggcagagaagtagagctggggagcatgaagcgatgaggaagataaagaatgagttcatgactcattgggatgggcttttgacaaatcaggttgagcgcatacttgtgctcgctgctaccaaccggccatttgaccttgatgaagcaattattaggcgttttgagcggagaattatggtggggcttccttctgcggagcacagggaaaggattttgaacactcttcttgggaaaagaaaagatggaaggactagattttaaggagcttgctactatgacagaaggatattcaggaagcgatcttaagaacttgtgcactacagctgcctatcggcctgtcagggagttgatacaacaagaaagattaaaggatttggtgaaaaaacaaagagctgaagcaacacaaaaattaggagaagctactgatacaaaagaagttaaaaaagagagagtcatcacccttagaccactaaatatggaagactttaagcttgcaaagaatcaggttgctgctagctttgctgcagaaggatcttcaatgaacgagttgcagcagtggaatgaattgtatggggaaggaggttcaaggaaaaaacagcagttgacctacttcttatgagatgaaactagaacccacaaccaaggaaagctcgtctcttcactgatggattgccaaagcttcttctttgccctcaaggttctcttctcatccctcaactaaattgaacagatgaacagagataggttgagcaaatgcgaaaaagaaaatgatgggaaaaactttcaactttctggtaaacttgaccttcatgtaatgtcgtattacctacctatatttggtgtatttataatgcttcagattaacagaccctaggaataagagcgcaacttgactgtgttgttttcggccatgctgcctgatgaaaatgaaacagtagtcatgttgatgaaattttcatctcatgttgtttctgggtagtgcttttaagttcatcttagcacattgaaaattggcatgaagcagcttctgctcgtcaattgtatctggctacttgctccacgttgtaacatgggaatcctcaccgtcctgaatctgtggcgaggtagcccatttctcatctgttgtaatgaagttaaattttacttttagcaggttgtgcttgctgctgttt

SEQ ID NO: 489 - DNA, 544 bp, Populus trichocarpa
ccactggagactatgtgttccaaaactgttctttgcaactcccatctgaggcgacatcaaatgaaagaaccagcaataatggaggaggtgacaataaaaatagttccattgggttatccatgatcaagacttggttaaggaaccagccagcaccgacgcaacaagacaccaataataaaaacaatggtggtgcacaaagtttgtccctttcaatgagtactgggtcacagtcagctgcttctgctctgccacttctagcagtaaatggaggagttaataatactgggggagatcagagttcttctgataataacaagcaacaaaagagtaccacaccaagtcttgatagccaaaccggtgccgtcgaatcggtgccaaggaaatctattgatacttttggccaaagaacatctatataccgtggtgtaacgagacatagatggaccggtagatatgaagctcatctatgggacaatagctgtagaagagaaggacaaactcggaagggaaggcaaggtatggggtggttatgacaaagaagaga

SEQ ID NO: 490 - DNA, 557 bp, Populus trichocarpa
taaaaagaaagcttatgtttgccccgagcctacgtgtgttcaccatcatccttcaagggctttgggtgaccttacaggtatcaagaaacattattgcaggaaacatggggagaagaagtggaagtgtgaaaaatgctcaaagatctatgctgttcaatcagattggaaggctcactctaaaacctgtggaacaagagagtacagatgtgactgtggaacccttttctccaggaaggatagcttcataacccacagggcattttgtgacgcgttagctgaagaaagtgcaagactctcagctcaccagctaattatctcccaaaatccaaatgcccacgctctcctccttcaaaacccacttcaaacccaccaccctcattctctcttttctaccacagctcaccaccaaatctccttcacttctccttgggacccacctcaccatcagaacccttgcagtaataaccccctaaacccagttcacatcaagcctgaaactaccggccattttcaaatccccgcttcacttctccaagaaccaccactaacaatgccta

SEQ ID NO: 491 - DNA, 1528 bp, Populus trichocarpa
gaggtgtttcagcactcgctttgagctctcttcctttcatagtcgttttttcctgatttgaaaagtagatgtttaagaagcagaattctccattttttctcaactgatcttcgaattgttataaaacaattttgacacaacccaaaaagaaaaactgaaaattctaaacaaagctagctagtggtggttgaggagcttttagaaatgcaagacacccactcaattggaggaggaggcaggttatttagcggtggaggtggaggtgacaggaaactacggccacaccaccaccagaaccaacaagcattaaagtgcccacgatgcgactcgctgaacacaaaattctgttactacaacaattacaacctctctcaacctcgtcacttctgtaagagttgccggcgttactggactaaagggggtgtcctccgcaacgttcctgttggtggtggatgccgcaagactaagcggtctaggcctaaacaaaatacaccaattacaacttgtgatacaattacggcctccagtaccacaccgcaggagctacaggaacaacatcagcagcgagatcataaatcctccgactctcattctagtagtgagagttcaagtcttactgctacaaataacacgaatgcaaatactacagcggaagcagtgtctgcgctctctgtaagctctgttgtctccaataatttattaaatggtattgttgaatccaaaatctttccgcatgggaatgtgaatccgagttttgaaccttctttgctcgagcaaggatcggactgtgggattttttctgagattgggagttttacaagcttgatcacatcgacgaatgacttgtttggatttagtaacatgatgagccaacaccagcccccgcaccagcaacaggggctcgagcatcatgtccaacataatcagaaccagcagcagtggcaaaatcatcaacagcaggagatgacaggaggaggggggttgattgatcagacggttcacgttgagttatcagctttgcctagtagtagatcaacaaagaatgatgatggggaatttggagcgttggactggcaattagggagtggtgaccaagctactagtttgtttgatcttcctaatgccgtcgatcaagcttactggagtcagagccaatggaatgatcaagatcaccctagtctctacatcccgtaaatctccttgctttttttaacttcaaattacagaagaattaaaaaaacaaatctctcaaaaaggaaatggaaaatataagtctgagagactatggaaattggaaaatatgaaatgactgctttccttttatgtaaatttttttatatccatcttctttttatttttctggggtatatctggtgattttaaaaggtacttgggtttgatttaaaacccaagtaacttttatgttagttattttcctctcttttttcccttctaattcttttggaaggtttttatttctgatgtatctaatgagattaaatcaaatcaagatatagagaagatagag

SEQ ID NO: 492 - DNA, 597 bp, Brassica oleracea
ggtgggaattaataattaaattctctaaagatcccacctctctctctctctctctctctctttttcttaacttggtttctcgaactataattattgactagtaatagtgagagaaacagatatagagtataaacataatttttttcgaagcatatattaaaagagaagatggttaaatcaagagacttgttgccgtccttggcgatggtattggtgcaaatcggctacgcaggcatgaacataacgtcgaagatggctatggaatccggcatgaagcctctcattcttgtcgcttaccgccaaatctttgccactatcgccacctttcccgtcgcattttttcttgaacgtaagacaagaccgaagatcacactaacggttcttgtccaaatcttcttctgctctatcaccggtgtgaccggtaaccaagtgctctacttcataggacttcaaaattcatctcccaccattgcttgtgccttaactaacctcttgccggcggtcactttcctactcgccgcaatcttcagacaagaagctgtagggatttaggaaggcatcaggacaagccaaagtgatagggacagtagtatgtgt

SEQ ID NO: 493 - DNA, 455 bp, Brassica oleracea
gggtgacgtggccgaggagaaaccggagagatccagtagaggagcccgcggcggagaggctgaggaatcttgttcccggaggcggagcaatggagacttcaaagctgatggaggagacggctcattatatcaagtgccttagcatgcaggtcaaggtcatgcagtgtcttgttgatggcttgtctccgaaatgatcatcatcaataatcataatcatcatcaatgatgcatataacgatatacgatacacatagtattggaatggggtgatcacatacgtgtaagatagggtatatgaatataaaatgtgtggatatgtattagtcaataagttacaaaagattttttttttaatttttgataataggggattttatatttatcattctatggctgtttaagttggtattgcttttgtatattaaaaaaaaacgttataaacattagggtttggg

SEQ ID NO: 494 - DNA, 421 bp, Brassica oleracea
tttctctccgactcggcgaacgtcacttccgattcgctgatcccttctttgtgtttcctctccggcgtaataatgacaacttcaaagaggctagcaggcaggaagatagagaagtttgataagaacattactaaaagaggttttgttcctgagaccaccaccaagaagggtaaggactaccctgttggacccatcctcctcggcttctttgtcttcgtcgtcattggttcatctctcttccagatcatcaggactgcaactagcggaggcatggcataaacgaaacctcttcttctttcttgtctcacttctcctttaatcttattgtagaatgctttagctttctgtgtactttactacatgttgtgaagaattttgagagtcttttctatataaaattatcaaaccttttaatgttgtc

SEQ ID NO: 495 - DNA, 713 bp, Brassica oleracea
gtcgatcttttctagcgatgtcgattcctcaggccaagatggagcttcgtcctctgggaaacacaggcctcaaagttagctcagttggcttcggcgcctctcctctcggaagcgtcttcggtccagtcgccgaagttgatgccgtcgccaccgtacgcgaagcgttccggcaaggcattaacttcttcgacacttccccgtattatggaggaacactatcggagaagatgcttggtaaaggactcaaggcactacaagtccctagaagcgactacattgttgcaaccaagtgtggacgttacgaagaaggtttcgacttcagcgctgagagagtaacgaagagcatcgacgagagcttggagaggcttcagctagactacgttgacatacttcactgccacgacattgagttcgggtctcttgaccagattgtgagtgaaacgatccctgcgctccagaaactgaaacgtgaagggaagacacggttcatcggtatcactggtcttccgttgagtattttcacttatgttcttgatcgagtgcctccagggacggttgatgtgatactatcgtactgccattacggtgtgaatgattcgacgttggtggatttgataccttacttgaaggggaaaggtgtgggtgtgattagtgcttctccattggctatgggtctccttacggaacaaggtggtcctgaatggcatcctgct

SEQ ID NO: 496 - DNA, 715 bp, Brassica oleracea
gactcactatcactaaaacaaagaacagaaatgggaacttcagtaataaaagctctcaaatatcttctacttttcaacatctcattgaccttcatctacaccaatgaagtctccgcttctccagtgactctaccggcggcaaagatgagccgtagacctgtagcggttcaaggcatggtttattgcaagtcttgcaagtactccggcattaatacgctcctagaagcatctcctcttcaaggagcgactgtaaagcttgcatgcaacaacacaaagagaggtgtgacgatggagacaaagacggacaaaaacggatactttttcatgttagctccgaataaactcaccacctacgcttttcacacatgccgggcttggcccacgaacccaggtcccgcggctgctacggtaacatgcaccgtcccttcacagctcaataatggaaccaccggtgctatgcttaagccttctaaatcaatcaacatagctgaacgcggctacgttttattctctgttggtcccttcgcgtttgaaccggcatgtactcgttgaagtctcgactttcttctttatgtatgtgtgtgcttgcttgttatgactatctatcactagtgctttaaatgttttcatcgtcgtgtttgcttttttagtatgttcacgttttaaagcttgtcttggtacacattttgagattgttggtgtgaaaaaaaaaaaa

SEQ ID NO: 497 - DNA, 583 bp, Brassica oleracea
aaccattagatacatccaaagttatgagtactaattagtgagctcaagagtactgtgacttatcaacaagttattccaattttcttctattttcttggcaaagagttgttgtagtgggaaactaagagagggaaaaaagttaaaaagggagtgatttttaattagattaagagagctcaagataatggtgagacctccttgttgtgacaaaggaggagtgaagaaagggccatggactcctgaagaagatatcattttagttacttacatccaagaacatggccctggtaattggagagccgttccgaccaatactggattgcttagatgcagcaagagttgtaggcttagatggacaaactatttaaggccaggaatcaaaagaggcaacttcacagaacatgaagaaaagatgattgttcatctccaagccctattaggcaatagatgggctgcaattgcatcatatcttccacaaaggaccgacaatgacattaggaactattggaacactcatttgaagaagaaactcaacaaagccaatcaagattctcatcaagattttgatcaatcaagagacctc

SEQ ID NO: 498 - DNA, 884 bp, Brassica oleracea
acacaaaaaaatatataacacaaagaaatagaagaaggaaaaaatgtccccctcctttcttttctttactttgtttttgataaaggaaatgtcctcttcatcatcagcaaactcctttgaggacggcaaatacaaaacagatcttttaacagtaggcttatcatcttgctgctggaaaaagccctcctcttctccgactccgcagtctccgccgaagaggcttttggtggcaacgccggtggaggaaggagaatatccggtggtgatgctcctccatggttaccttctctacaactcattttattcccagcttatgttgcatgtctcttcccatggcttcattgtcatcgctccgcagttatatagcattgccggaccagacaccatggatgagataaaatcaacggcagagattattgattggttatcggtcggactaaaccactttcttccaccacaagtaacaccaaacctatccaagttcgcactctccggccatagccgtggtgggaagaccgcatttgccttggccttaaagaaatttggatactcgtccgacctaaagatctcggcattgataggtatagatgttggaactgttttttggacaaatggctatggccaatattccggtgaatttttcgagcaatttgattgtcgaaatgaccggattgtggaatcgtaggattcattgttatgagcactatggtatagtgtaatcatatatcaaaaacgaagttcgtttgaatgagaaatgaaagtctaaaatagattatttgtaaaatatctatattagaattatgaggtaagaaacctcttgtgtttaaaatggagaagttataacaaagttataaaaaactttgtaaacaatttggtgtgttagc

SEQ ID NO: 499 - DNA, 1104 bp, Brassica oleracea
agagaaaaaaagtgaaaaaaataacaaagagaagaaaaaaaatgtcatcttcttcatcaagaaacgcctttgtggatggcaaatacaaaccagatcttttaacagtggatttagcatctcgctgtcgctgctacaaaacgacgccatcttcttctctgactccgccgcctcctcccaagtcgcttttggtggcaacgccggtggaggaaggagaatatccggtggtgatgctcctccatggttaccttctctacaactcattttactcccagcttatgttgcatgtctcttcctatggcttcattgtcatcgctccgcagttatataacattgccggaccagacacgatagacgagataaaatcaacggcggagattattgattggttatcagtcggacttaaccactttcttccaccacaagtaacacccaacctatctaaattcgcactcaccggccatagccgcggcggcaaaaccgcattcgccgtggccttaaagaaatttggatactcatcggaactaaagatctcagcaattatcggtgtagatccggtggatgggacagggaaaggtaaacaaacccctcctccggttttaacctatgaaccaaactcatttaacctagaaaagatgcctgttctagttattggttcgggacttggtgaacttgcccggaacccattgtttccaccgtgtgcacctacgggagtgaaccaccgagagtttttccaggaatgtcaaggtccagcgtggcattttgtcgcaaaggattacggacatttggacatgcttgatgatgatacaaaagggcttagagggaagagttcttattgtttgtgtaagaatggtgaagagagaaaaccaatgaggagatttattggtggaattgttgtgtcgtttttgatggcttatctggaagatgatgattgtgaattggtgaagatcaaagctgggtgtcatgaaggtgttcctgttgaaattcaagagtttgaggttaaaaagtaattttctttagagcttgtttttcctattttcaatatacaatagtcacactgcttatgaaatattgtttagtctttactcaagtgacatcttgactcat

SEQ ID NO: 500 - DNA, 540 bp, Vitis vinifera
ggctctgtttttcggccggaagcgaaagagagagcgcgaatcgcctgagaattctccgacgatcttgtgcttcgacattttccggccaccggatctcaccgtaaacatgacaacatcaaggcgtcttgcagataggaaggtagagaagtttgagaagaacatcactaagaggggatctgtgcctgaaacgactactaagaagggaagtgactatcctgttgggcctgttctgcttgggttcttcgtctttgttgtcattggatcttctctgtttcagataatcaggactgcaaccagcggtggcgtggcttaatatacatgtgtcaacctttaaatcctagtggagaagtagagaactgataatacatgatgttttgtgaggactcgtaccaataaagttatatatcaattcctattctcattttttatatcttttttttcacttttcgcttctgctcaaattgttggatctatgttagtatctttaggccccatttatcttttaatgatgagagggtcccggccgaatgtgtatgctta

SEQ ID NO: 501 - DNA, 628 bp, Vitis vinifera
gacgagatgaaggaagataataaaaaaggcagttgagaatagctaaggcttatcgcatgtttgcttcacgcaagcagctaaatggggtttgctgcatcgcgtggctttaaaggttttatctactgtttaaatcccaatcccaatatcacccccaccaaaccctaaacccacccctccttttcttcttcttcttcttcttcttcttcttcttcttcctcttctccttcccgtaaaccctaattatgtgaagaaaaacaacaaaccaaaaccgccccagaaacagtaattaagatgagtgcaaacactagtagcagcggtggcggtggtggtggcggtggcggtggaagcaccagcggcggaggcggtggtggtgggccttgtggggcttgcaagtttctaaggagaaagtgtgtggtgggatgcatatttgcaccttattttgatccggagcaaggagcagcccactttgcggccgtgcacaaggtgttcggagccagcaatgtttccaagctgcttggccatatccccgtccacaaacgactcgatgcggtggtcactatatgctacgaggctcaagctcggctcaaagaccctgtctacggctgtgttgcccacatatttgccctcc

SEQ ID NO: 502 - DNA, 561 bp, Vitis vinifera
tcattcacagaaatcatgcgtgagagtataactactttcatcaaagaaagtgttgatgaagaattaaaggacaattccgactctgatgcaaagcctacccagaagaagcgactcaccttctgtgttgaaggaaatatcagtgttgggaagacgactttccttcaaagaatagctaatgaaacacttgagctacgtgatcttgttgagattgttcctgaacctattaacaagtggcaggatgttggacctgatcactttaatatattggatgcattttatgctgagccacaacggtatgcctatacctttcagaattacgtgtttgttaccagagttatgcaggagagagagtcatctggtggagttaagcctctgaggttgatggagaggagtgttttcagtgacaggatggtatttgtacgagctgttcatgaagcaaactggatgaatgagatggagatcagcatttatgactcatggtttgatcccgtagtttcatgcttgcctgggctgattcctgatggcttcatctatcttagagcaacccctgatacctgccac

SEQ ID NO: 503 - DNA, 718 bp, Vitis vinifera
gaactttgcgctcttggatccatacagaagagaacaaaaggagaacacttcagaagaacgatattgctgctgccatttcaaggactgatgtttttgacttcttggttgatattattccaagagatgagctgaaagaggagggtcttggggtcactaaggctagtattccagtggtgggttccccagctgatgcgattccatattactacgttcctcccccaccagtaggacctacaggcatgatcatggggaaggcagttgttgatcaatcatcgatatatgctgcccaacagcctcgacctcctgtgcctttcatgccatggccacaggcgcagtctcagccccagcaaccccaacagcagcaaacagatacttgatgaatcgggccaaggtgtgtgccttctggggccctgttagagacaaacccttatcgtgtctttagtcatagtgtagttgctttgtagtagtagtgttagtagacaattacagagctgaaactagtagatgataccaaatcaaatgtgaggcactcagcatcctgtaatagactttgtgttgctcttaatttgaggtgtcctcaggagaagtgttgttttgtggaagaagaggatgttaccccttttgtccttgaatcaatctgtatgagcaaaacatcaattctggtttgcatggattatcactttctcagttgcagtagtttcgcttgttatacatcatt

SEQ ID NO: 504 - DNA, 839 bp, Vitis vinifera
aaagtcaaaacagcacagggaatagtttgggaggacgaagaaccgaactcgcgcttttcccactaattctatataatattattattttttatatagtttttagcaaacatttattccttcctcctaagtgctattaattctcatcttccacttcccaaaaaaagggggaaaaacagtgttgaaaagggtttgaatctgcgaagaagatcaacagacggaagcagattcttgatatctacacataaaggtaaagttttagagcaaagattttgtttaaagcctaccttgcctgaatggatcagccagggcatgggcagcccccggcaatgggcatggttggtagtgcagctcaaatgccatatggtatccctccatttcaacctaaccaaatggttgggacctctggacctggaacggttggatcaattcaatctcctactcagccagcaggtatctcttctccagctcagctggcacaacaccaacttgcttatcagcacattcaccagcagcagcaacagcagctgcagcaacaactccagaacttttggcaaaatcagtaccaagaaattgagcagactactgattttaaaaaccatagtttgccattggctaggatcaagaagattatgaaggcagatgaagatgtaaggatgatatcggcagaggccccggtcatctttgccagggcatgtgagatgttcattcttgagttgacactacgatcatggaatcacacagaggagaacaaaaggaggacacttcaaaagaatgacattgcagctgcaatcacaaggactgatataatttgatttcttagttgatattgtcccacgtga

SEQ ID NO: 505 - DNA, 1722 bp, Triticum aestivum
  misc_feature (6)..(6): n is a, c, g, or t
  misc_feature (37)..(37): n is a, c, g, or t
  misc_feature (44)..(44): n is a, c, g, or t
  misc_feature (95)..(95): n is a, c, g, or t
  misc_feature (132)..(132): n is a, c, g, or t
  misc_feature (168)..(168): n is a, c, g, or t
  misc_feature (201)..(201): n is a, c, g, or t
ttgtgnccggccagtcttccttaccatttggttcatncccaagnatccttgaatccaaaattgggaagctcccttttttttcccaaaagtttgtntcattggattaaccatttttcaagaaattggccttgntgggaaagacacgttgaaactcgaagcaaacgaggntgttctgaaaggtgcacttgaatctaagaaacntgggagtgataaatcgccgggtaaagatggggatgccccaccgccaaaaccagaaatacctgacaatgagtttgaaaagcgtatcagaccagaggttataccaccaagtgagctaggagtgacatttgatgacattggagccctggatgatatcaaagagtcgcttcaggagctggtcatgcttcctcttcgacggcccgaccttttcaagggaggaggacttctaaagccttgccggggaatattgctgttcgggccacctggaactggcaagacgatgcttgctaaggctatagcaaatgatgcaggtgccagcttcatcaatgtgtcaatgtccacaatcacatcgaaatggttcggggaggacgagaagaatgtccgagcattgttcagcttggctgcaaaggtggctcctactataatctttgtggatgaggtagatagcatgttggggcagcgcgctcgctgcggtgagcatgaggcgatgaggaagatcaagaatgagttcatgagccattgggatggcatcttgtcgaagtctggcgaaagaatcctcgttcttgccgcgacaaatcgaccgttcgaccttgatgaagccatcattcggagattcgagcgcagaatcatggttggccttcccaactcaggatagcagagagctgattttaaggacagttttgtcgaaggagaaggtcgataaagacatcgagtacaaggagcttgcgactatgaccgaaggttacagcggcagtgatcttaagaatctttgtgtgacagctgcttaccgaccggttagggagcttctgaagaaagaacggttgaaagagatggaaagaaggaaaacagaggcggaacagaaaaccgccgcggcagcagaggattcagacaagccagagaacaagaaggtgagttcagataacaaagaaaacaatccagagaaggtggattcatcagatagcaaagagggcagttcagaaagcaaagacgatagttcagaaaccaaggctgaaggcgacaaggaagcggtcgtcgatcttaggccgctgacgatggaggacctgaggcaggccaaaaatcaggtcgccgcgagcttcgccgcagagggcgctgtcatgaacgagctgaagcagtggaacgacctctacggcgaaggagggtcgaggaagaaggagcagctgacctactttttgtagaaccggacgggcggtgaatctgaatgcgttgtgttgggcaaatcgctgaagccttggcagcagagcatgagcatacatatgttggtggaagaggagagagggtttcatgtgagcaaccttgagttaggatcttggaatgaatggactccttgacatgtgtggccggtggcattggatcatgtgcgattcttttatacgaacaagtattgtagctattcattattatatatgttgtagctggtttgttagcctgtgtgtatatctggattgaattttagcatgaactatttatgtttaggctgtttgtaatgtgaaggactattagaaa

SEQ ID NO: 506 - DNA, 1364 bp, Triticum aestivum
gcacgagagcgggcgagacgtgagcatggggaggccgccgtgctgcgacaaggagggcgtcaagaagggcccctggacgccggaggaggacctcgtgctcgtctcctacgtccaggagcacggccccggcaactggcgcgccgtccccaccaggaccggcctgatgcggtgtagcaagagctgccggctccggtggaccaactacctgcgcccagggatcaagcgcggcaacttcaccgaccaggaggagaagctcatcgtccacctccaggcgctgctcggcaacaggtgggccgcgatcgcctcctacctccccgagcgcaccgacaacgacatcaagaactactggaacacgcacctcaagcgcaagctgcaggcggggggcgacgccgcggccaagccggcggcgcagaggcctgcctcctcctccaagggccagtgggagaggcggctgcagacggacatcaacatggcgcgccgcgcgctgcgcgaggcgctcaccacgctcgacgacatcaagccgcagcagcccgacgcggccgacggcgtcaatgggcctgccgcagccggcgccgacagcggcagcccggcggcctccagctcgtcggccgcgtcgctgtcccagtgctcgccctccgcggctgggccgtacgtgctcaccaccgcgaacatctcgcggatgctcgacgggtgggccagcaagggtcgcagcgccggggccgcggcggacagcccctctggctcgtcggcgtccgaggtttcctacggcagcggcgcggccgcccgtgcgctggggtccgcgttcgagtacgacaggaagccggccgttctggcgccggatcagacgcagctgaacgcgatcgagacgtggctcttcgccgacgacaacagcaacaacgaccaccatggccacgcagccggcggcagcggcttgctcggcgtccccgccatgggttaccctttctagctagctctaccgtgccaagttattaaggtcgatgttctcctagctcgcgttactgatgtgaggagtgtgttcactgcatgcccacctaacgaaaactacatagatcctctagtagtagtacctcggtggctatggcaatcagcttccttggtctcctgattacttaggatctgcatagttttcatttagggaaaagaaagggaggttgtggtagcttagtgctcctgttatttactgctgtaactgtgacttggtactatgttatgttcatgggttttgggttttgtactttgaagtagatccgctgtttgcaagctgcaaaatgtggacgaataaagtcagtatgtcaattagtacatgtcatgtcttctatcactaattaaccagtatgccaaat

SEQ ID NO: 507 - DNA, 499 bp, Triticum aestivum
ccacgcgtccggaaacagacgagatcaaatcaagctggagccagagagctagggagagagagaaagtgatccaacagtagtgatggggaggccgccgtgctgcgacaagttgggcgtgaagaagggtccgtggacgccggaggaggacatcatcctggtctcctacatccaggagcacggccccggcaactggcggtctgtgccggtgagcaccggcctcatgcgctgcagcaagagctgccgcctccgctggaccaactacctccgccccggcatcaagcgcggcaacttcacaagccacgaggaaggcgtcatcgtccacctccagtcactcctcggcaacagatgggcagcgatcgcgtcctacctgccgcggaggacggacaacgacatcagaactatggaaccgccctcaagaaaactcagaagcacagcatgggagcatttcgcggtccgaagataccaccagcgcgagcgttagtctttggtccctgccgat

SEQ ID NO: 508 - DNA, 1620 bp, Triticum aestivum
gcacgaggctcctactacctcaccccgctccctccagcgcaccacaggcttcgtctccacctcacctcagtcccctctcctcacctcactccatttgtagcgtagcagcggcccgcgtcacgcgatcctgctcgtatacggcgccggtggctagactccttgtccccgcccgcccaagcctgcagcaaaaggcgaccgacccctccgtccctttctttctttcatcgtctcgttcggtgtggccgaggtagcgagcgggggagcgggcgagacgtgagcatggggaggccgccgtgctgcgacaaggagggcgtcaagaagggcccctggacgccggaggaggacctcgtgctcgtctcctacgtccaggagcacggccccggcaactggcgcgccgtccccaccaggaccggcctgatgcggtgtagcaagagctgccggctccggtggaccaactacctgcgcccagggatcaagcgcggcaacttcaccgaccaggaggagaagctcatcgtccacctccaggcgctgctcggcaacaggtgggccgcgatcgcctcctacctccccgagcgcaccgacaacgacatcaagaactactggaacacgcacctcaagcgcaagctgcaggcggggggcgacgccgcggccaagccggcggcgcagaggcctgcctcctcctccaagggccagtgggagaggcggctgcagacggacatcaacatggcgcgccgcgcgctgcgcgaggcgctcaccacgctcgacgacatcaagccgcagcagcccgacgcggccgacggcgtcaatgggcctgccgcagccggcgccgacagcggcagcccggcggcctccagctcgtcggccgcgtcgctgtcccagtgctcgccctccgcggctgggccgtacgtgctcaccaccgcgaacatctcgcggatgctcgacgggtgggccagcaagggtcgcagcgccggggccgcggcggacagcccctctggctcgtcggcgtccgaggtttcctacggcagcggcgcggccgcccgtgcgctggggtccgcgttcgagtacgacaggaagccggccgttctggcgccggatcagacgcagctgaacgcgatcgagacgtggctcttcgccgacgacaacagcaacaacgaccaccatggccacggaggcggcggcagcggcctgctcggcgtcgccgccatgggttaccctttctagctagctccaccgtgccaagttatgaaggtcgatgttcccctagctcttgcgttactgatgcgaggagtgtgttcactgcatgcccacctaacgaaaactacatagatcctctagtagtagtacctcggtggctatggcaatcagcttccttggtctcgtgtttacttaggatctgcatagttttcatttagggaaaagaaagggaggttgtggtagcttagtgctcctgttatttactgctgtaactgtgacttggtactatgttatgttcatgggttttgggttttgtactttgaagtagatccgctgtttgcaagctgcaaaatgtggacgaataaagtcagtatgtcaattagtacatgtcatgtcttctatcactaattaaccagtatgccaaat

SEQ ID NO: 509 - DNA, 765 bp, Triticum aestivum
ctttgtttgaactcggccttctcaactccacacagtctatctaggtgggtatgacaaagaggagaaagctgcaagagcttatgatttggctgctctcaagtattggggtgccacgacgacgacaaatttcccagtaaacaactatgaaaaagagctagaggagatgaaacacatgacaaggcaggagtttgtggcgtctctgcgaaggaagagcagtggtttctccagaggtgcatccatttatcgtggagtaactaggcaccaccaacatgggaggtggcaagcgaggatagggagagttgcagggaacwaggatctctacttgggcaccttcagcacgcaggaggaggctgccgaggcgtacgacatcgcggcgatcaagttccgggggctcwacgctgtcaccwacttcgatatgacgcgctacgacgtcaagagcatcctcgacagcaccgcgctccccataggcagcgccgccaagcgcctcaggacgcagaggcggccacggcgtcgtccctcgcgctgcagcagcagcagcacgcaggcgttgtgagcggctacgacatgggcgccyggccgcctacggtgcggcgtaccaccaccatcacccctccgtcgccggcgctgttgcgtggccgaccatcgcgttccaggcgccgcctcagcaggtttctggcggcggtggtggacacatgtaccacccctacgcccatgcgcagccgctgcgcgggtggtgcagcggagccggaccccgcggtgatcgcg

SEQ ID NO: 510 - DNA, 1663 bp, Triticum aestivum
atccgctggggagaaacggcgcgttggtggtggcggggagctcgcagagcctggcgctctcgatgagcacgggctcaggatcgcacttgccgatggctgtgctcggcggcagtcccagtgggggagtctcagagagcacctcctcggagaacaagcgggccagcggcgccatggattcgccgggcggtgcggtagaagctgtcgcgaggaagtccatcgacacattcgggcaaaggacgtcgatatatcgaggtgtaacaagacatagatggacagggcgttatgaggctcatctctgggacaatagctgcagaagagaagggcagagtcgcaagggtaggcaagtttatctgggtggctatgacaaggaggacaaggcagcaagggcttatgatttggcagcactcaagtattggggtacaacaacaacaacaaatttcccaattaatacctacgaaaaagaggtggatgaaatgaaacatatgactaggcaggaatacatcgcatacctaagaaggaatagcagcggattttcccgtggtgcgtcaaaatatcgtggtgtaactaggcaccatcagcatgggagatggcaagcaagaattgggagggttgcaggaaacaaggatctctacttaggcaccttcagcaccgaggaggaggcggcggaggcctacgacatcgcggcgatcaagttccgtgggctgaacgccgtcaccaacttcgacatgagtcgctacgacgtcaagaccatcctcgagagcagcaccctgccggtgggtggcgcggcgaggcgccccaaggaggtcgctgatcatccagaggctggcgccacgatctggcgggccggcatggacggcggcgtcatctcccagctgaccgacgtcgggatgggcacgtacgcgtcgtaccaccacggctggccaaccatcgcattccagcagccctcgccgctgtcggtgcactacccatacgtcgcccagccgtctcgcgggtggtgcaagcccgagcaggacgccascgtcgccacgcaaagcctgcaggacctccagcagctgcacctcgggaccgccgctcacaactatttccaggcatcgtcgagctcmacggtctacaacggcggcggcgtcggcgggtaccagcarggcaccrgtggcaacgccttcttgatgccggctagcaccgtkgtggatgaacaggggcacagcagcactgccrccaaccagggaagcacmtgcagctacggggacgaagaggggaagctcaatctygggtacgatgccatggcgatggcgagcaccggcgccgacccatacgcggcggcgycaactgtgagcatygcgagggcgaacgggtactccaacaactggagctcgccgttcartggcatgtgatratggtgaagagggcagamgctagtaatagcgggattmattagctagcwagasartcgaaaagttaggtcaggggtmttgctcgttgttgcgtttcrgctcagggttccggctagctcttcttggccgggtggatgacacwcgtaaaggtgctrygcatgcatgccttctggaagctggtaatggcaagtcaggataggtaaagcttgtgtcgttgtaagttaattatcctgacttgctgttagttttgggtagtttcagaaggatcaagt

SEQ ID NO: 511 - DNA, 1229 bp, Triticum aestivum
tatcgtggtgtaactaggtatgttactaggtaattcggtctgttatgtttaccataataatttatgtcatgtggaaatagctaatgtccgatatgtattcttagaattagtaggcatgcacgtaagcaaacatgtatgttagatacgttatccaaatggatgttatatcttttttcgattttctaagttctaactatataaggctgagatctttaccaggcaccatcagcatgggagatggcaagcaagaattgggagggttgcaggaaacaaggatctctacttaggcaccttcagcaccgaggaggaggcggcggaggcctacgacatcgcggcgatcaagttccgtgggctgaacgccgtcaccaacttcgacatgagtcgctacgacgtcaagaccatcctcgagagcagcaccctgccggtgggtggcgcggcgaggcgccccaaggaggtcgctgatcatccagaggctggcgccacgatctggcgggccggcatggacggcggcgtcatctcccagctgaccgacgtcgggatgggcacgtacgcgtcgtaccaccacggctggccaaccatcgcattccagcagccctcgccgctgtcggtgcactacccatacgtcgcccagccgtctcgcgggtggtgcaagcccgagcaggacgccagcgtcgccacgcaaagcctgcaggacctccagcagctgcacctcgggaccgccgctcacaactatttccaggcatcgtcgagctccacggtctacaacggcggcgggtaccagcaaggcaccagtggcaacgccttcttgatgccggctagcaccgtggtggatgaacaggggcacagcagcactgccaccaaccagggaagcacatgcagctacggggacgaagaggggaagctcaatctcgggtacgatgccatggcgatggcgagcaccggcgccgacccatacgcggcggcgccaactgtgagcattgcgagggcgaacgggtactccaacaactggagctcgccgttcaatggcatgtgatgatggtgaagagggcagacgctagtaatagcgggattcattagctagcaagacagtcgaaaagttaggtcagggtattgctcgttgttgcgtttcagctcagggttccggctagctcttcttggccgggtggatgacacacgtaaaggtgctgtgcatgcatgccttctggaagctggtaatggcaagtcaggat

SEQ ID NO: 512 - DNA, 901 bp, Triticum aestivum
  misc_feature (859)..(859): n is a, c, g, or t
  misc_feature (862)..(862): n is a, c, g, or t
  misc_feature (888)..(888): n is a, c, g, or t
  misc_feature (896)..(896): n is a, c, g, or t
ccacgcgtccgctctctgtctctctctctccgcctccgccgagggcttccgagaatccaccagcggagcagcgagacagggacccctccgccgtcaccaacaccgccctactcgccgccgcctcaccgcctccaccgccatcttctacgtcctcccgtccccgtaccggagatccggcggttctcgtgaccggaagatatttggctttgcacgaacaagatctcacatggagccatcctcgcagcctgagcctgtcgtgggtgtggccactgctgggtcacaagcatatcctcctcctgctgcctatccagctccagccatgcctgccgccattcctcctggctcgcagccagcagtgccattcccagctaatccagctcaactcagtgctcaacaccaactggtttaccaacaagcccagcaatttcaccaacaactgcagcaacagcagcagcagcaacttcgtgagttctgggctactcaaatggaagagattgagcaggcaactgacttcaagaaccacaccttaccactggcaaggataaaaaagataatgaaggctgacgaggatgtccggatgatctccgcagaagctcctgttgtctttgcaaaggcatgcgaggtgtttatcttagagttgacacttaggtcatggatgcacactgaggagaacaagcgccggaccttgcagaagaatgacattgcggctgccattaccaggactgacatctacgacttcttggtggacatcattcccagggatgacatgaaggaggaaggccttgggcttccgagggtgggcttgcacctgctgctctaggggcacggctgatgcctatcctccttattatatgtgcancanacaggtactcggcgcgacacgctatngattccgnggcgc

SEQ ID NO: 513 - DNA, 668 bp, Triticum aestivum
tggtccagacacaatccgaaccgtctgttcggcacttaaatgcgcagtggttgtcgtgtctggacggcctgtcgttattgaaccatatcttcctctgatggaagcgcttgttgccgcctggcttcctggcacagaaggccagggtatcgctgatgtgctatttggggactatggcttcaccggaaagctttcgcgcacctggttcaagtctgtggatcagctgcccatgaattttggagacccacactatgatccgctcttccctttgggcttcggtttggcaataaattcatcacagccagggttctcgggcaccagaagccgcggagataagaaggaaattacggtatgggccgcgttgagtttgctactgtcaatgatgatagcttgggcataggtgtatttcagcactaatctgctcttttgtagcagtagcatgatcaatcaatccccttgctagggatccttgatccacacggatattgttccctgcagatggcgttatgctaacctaggtcttcggtcggtagatttgttgattcatcaaattatctttggttcacgtcttgtatttgtttctaatctagtggtgaggacaaagtagtagtatgattttaagaacatgcaagtcctgttggataatgaattacagcagcacattcagcttc

SEQ ID NO: 514 - DNA, 432 bp, Triticum aestivum
ggggtttgaggggcagggcgtggcggacgtgctgttcggcgactacgggttcacggggaagctgtcgcggacgtggttcaagtcggtggaccagctgcccatgaacgtgggcgacaagcactacgacccgctcttcccgttcggcttcgggctcaccaccaagggcgcgaaatgagtacgagacggcctgtgagtgactgtgagtgactgagtgaattgtgtgcttgtggggggcgtgacgaggctttcgaattagttgggggccaggtgagtagggaacgaacgccgcacacattgggcagcgttggggcctgtgggtaataacagtggtgcattcttgaggcggtggttgttagtgagtgggttgtttggaatgaacaataagagatcaggcgcgttacgttcgcgctggtatgcaggatgctacctccg

SEQ ID NO: 515 - DNA, 581 bp, Triticum aestivum
ggcacgagcacagaagggcagggtgtcgctgatgtgctatttggggactacggcttcaccggaaagctttcgcgcacttggttcaagtctgtagaccaactgcccatgaattttggagacccacactatgacccgctcttccctttcggcttcgggttggcagtaaattcatcacagccagggttctcgggcgccagaagccgcggagataagaaggaaattagggtatgggccgcgttgagtttgctactgtcaatgatgctagcttgggcataggtgtatttcaccacgaaactgctcttttgtagcagtagcatgatcaatcaatccccttgttagggatccttggtccacatggatattattccctgcagatggtgttatgctaacctaggtcatcgggtagatttgttgattcatcaaattatctttggttcacgtgatcacgtcttgtatttgtttttaatctagcgatgaggacaaagtagtaagattaattaaaacatgcaagtcctgttggataatgaattacagcagtacattcagcttcgagttgaatcattgcacataaatttcctacg

SEQ ID NO: 516 - DNA, 304 bp, Linum usitatissimum
cccggctcgagccctgggcgacttgaccgggatcaagaagcactttagtaggaagcatggggagaagaggtggaagtgcgagaagtgttcgaagaaatatgctgtccagtctgattggaaggcccattccaagtcatgtgggactaaggagtacaaatgcgattgtggtaccgtattctccaggagagacagcttcataacacacagagcattctgcgatgccctagctgaggaaaccaaagcatcagctggaatcatagtgaatcactccactccacaatcagtatctaattaccaaatcacc

SEQ ID NO: 517 - DNA, 548 bp, Solanum lycopersicum
cggccaaatcggccgaattgatcaataagacaaaataaaattggggcaaagggaaggaggaacaacttttagctgaaatataattctctctgcaatttttctgttctcatatatcggcggccaccacattttccttttaaaatgactacatcaaggcgtcttgctgataggaaggtggagaggtttgagaaaaatattaccaagcgaggagctgttcctgaaactactgcaaagaagggaagccagtatccagttggccctatcttgcttggattcttcgtctttgttgtcattggctcatctttgttccagataataaggacagcaaccagcgggggtatggcttaatcttgcaaagttatacgagtagtggcgcctgcgttgttgtagttttgttttcctcaaagtttagctcaatgtagaaatgaaaaaaaaaaaaacttttgtagtaatgtgtttttttaatttgtgagactcaaaatataaattttctcgtctcattatgtggttgccggcaaattgtggaaagctgaatctctcgagggggg

SEQ ID NO: 518 - DNA, 458 bp, Solanum lycopersicum
gcggataagaccagaggttataccttcacatgagattggagtgacatttgcagatattggtgccctagatgaamchaaggaatcacttcaggagctagtcatgcttcctcttagaagacctgacctcttcaacggtggactgcttaagccttgcagaggtatactactctttggtccacctggcactgggaagactatgctggccaaagcaatagccaatgaagctggagcaagctttataaatgtctcaatgtcaaccattacttcaaaatggtttggggaagatgaaaagaatgtccgagctcttttcacacttgcagcaaaggtttctccaacgattgtttttgtggatgaggttgatagcatgctagggcagcggacaagagttggagaacacgaggctatgcgaaaaattaagaatgagtttatgactcattgggatggattattgactaaac

SEQ ID NO: 519 - DNA, 725 bp, Solanum lycopersicum
gtatggggaggccaccttgttgtgataaaattggtatcaaaaaaggtccttggactcctgaagaagatatcattttagtatcttatattcaagaacatggtcctggaaattggagatcagtccctactaatactgggttgatgagatgcagcaaaagttgtaggctaagatggacaaattacttgaggccaggaatcaaaagggggaatttcactccacatgaagaaggaatgattatccatcttcaagctttgttgggtaacaagtaatcttcttcaccttcttagttactttttttttttactcattgtaattttaatcatacaattaaaaaaatattaaaaatattgaaataagtgtaaacagacagtgaaaattcatatagctgacttttcaacttattaaaaattgaaatgtatatgtttgtccagatgggcagctatagcttcgtatctacctcaaaggacagataacgatatcaagaattactggaacacgcatctgaagaaaaaactcaagaaattccaaatwgaattggattcacataatttgactcttyctcctcctaatttagacaattctaacactaataactatgatcatcatcatcatcaattcacaaagttattgaactctccaaattcttcatcttcatcatcattatatgcttctagtactgaaaatatttcaagacttctagaaggttggatgagatcttcccctaa

SEQ ID NO: 520 - DNA, 715 bp, Gossypium hirsutum
cccccccccccccccacacacccaaagaaaaatcgtcgccgtaaaagaaagagaagaatttcgcctgaaatttcattcgctttctcgaccggctacctcttctctccgacatcatgacaacatcaaggcgcattgcagacaggaaagtgttgaagttcgaaaagaacataacaaagagaggagctgttcctgaaacaagcacaaaaaaggggaaggattatcctgttggccctatgttgcttgggttcttcgttttcgttgtcattggatcatctctcttccagattatcaggacagcgaccagtggaggcatggcataaggctgcatatagcccatgttaaaaaaaaaaatgcagaagagacttgttatgttctttttctatagtgttgtagcgaactgatgatataatatgtttactagatatgcgttgtaactcatgttgtgaagatttcaaaaatttaattagaccagatgaaatgggccaaaagcatgcctctcgtgatgttaaaacacaatagatacaccagatgatgtggttgtttaatgttggcaccattcatggtttgaagttttcaattgtttgattcacactcatgttttgagaaatatttaccattcaaaatgtaraaaaatcggagtytttgtttaaagaaatgcattgagaaagggtggatgcatagaacctttcaatgagatcatgctttttcaaattta

SEQ ID NO: 521 - DNA, 1822 bp, Gossypium hirsutum
ggatggatagttgacatcttctatcaaatccggacattttcgcgagaaagtgagagatcgagagagaaaatacttcgcagggaattagcgagatcctgaaattttcctgcgttttctctcttcaatcttctccggctacctgatctatccgtcatcatgacaacatcaaggcgtcttgcagaaagaaaggtggagaagttccaaaagaacataacaaagagaggagctgtgcctgagacaaccacaaagaaggggaaggattatcctgtcggtcctgtgcttcttgggttcttcatattcgtcgtcattggatcatctctcttccagattatcaggacagcgaccagcggaggtatggcataagtctgcacttctgatgttaaggaattgcgaggagactggtcatgcattgggctttgcttttctgttagttttgtagggaaaaactgatgatatatttactagagatatatgcttacgatgtgaaatgtttggaatttgaataagacctcccctttagttgtctggtcattgtgctttgtctgctacttttttcatttatgcaatgagatggacaaaaaactgatatattagtggttgaaccgagttacccgagtaacttggtatttgaatggttataccaacagcttcagcagatgatgcgtaaagatttttatttattcgagctttctcacattcaatcccgctagatttagcttctatatgaacctcattcatcaaatttagcactgagtagagaatttcctgtttagtgtaatgaatctattaaaagaggaagcttaaccgctcaatttacctgtcactattatctcaatgcaacaagacagcagaagtttcacacgcctcattaagaaccaagcgtgttattcacccacatgtccaaacgaaaagaagaaaataaagaaaaagcccattccaatttccatgcaaccaaaaagaaaatacggccttaggtgggacttgttagcagcaaccgaacataatcgggaaacattaaaataggaaatagtttccttgaaacataaagggttggaaatcaagcagtagcagtcaagcaggggttaaaagcaatgcaacatgctacccgctgttgctttctaccccgtggtacaacacatccaggaaccttaagccactccctgctcatcacattgtatgtaactaatcggttcatttgtctcgatctcagttgcaacatgagcaaaccttcgttgcccgagcaagtcattcgaacgtgcttcccgtaaaactctaagcaccatacgtttggcattctgtcaacctccttccacaagagagtcatcttctgcagctcccatatacagacacaagtggcagcatttttggtcagcaatccaacgagcatgatcctgcccttacactctgcaagcgagtggtcactcagatgtaatggggctggaataataaattgtttgcataccccggtatccatgttgtaggacacaatcccttcagggtccgaccgcatgaagcaaagtgtgttatcaacagaaacagcttgagacagaaagttaagtgatagtggcaccttaatgtttgagggcatgcgtcctggccgactccatgaattcttcactgagtcataaacttcacactctccgtcacgtcccacccacatgaccttgtagcctccagtggttgagtttccattcagagtcattcctacagtaattcgcgaccacactttaactgacccagttggcaactctttaaatgaccgagtcaaagggttgcagacatagattttcctatgaccaatatcaagaaagcaaactagacc

SEQ ID NO: 522 - DNA, 1380 bp, Gossypium hirsutum
  misc_feature (1331)..(1331): n is a, c, g, or t
gatctaaagaatcacttcaagagcttgtcacgcttccattgcgaaggccggatcttttcaacggagggcttctcaagccttgtaaaggtatcttactctttggccctcctggtactgggaaaacaatgcttgcaaaagctatagcgaacgaagctggagccagtttcattaacgtctcgatgtctactattacctcgaaatggttcggtgaagatgaaaagaacgttcgagctttatttacactagcagcaaaggttgcaccgactattatctttgtggatgaggttgatagtatgttggggcagaggactcgagttggggaacatgaagcaatgaggaaaatcaagaatgagttcatgacacattgggacggccttatgaccaaagccggtgaaagaattctagtccttgctgcaaccaacaggccatttgaccttgatgaagcaataattagacggttcgagcgcagaatcatggttggtcttccatcgattgagagcagggaaatgatattgagaaccctactgtcaaaagaaaaagctgaaaacttggactacaaggaacttgcaaccatgacagaaggatacagyggaagtgatctcaagaacttatgcgtgacagcggcttatagacccgttcgagaactgatacagcaggagaggttgaaagatcaggaaaagaagaggcaagaagaagcaggcaaaagcactgaagatgttacagagtcaaaagaagagcataaagaggaaagagtcgttactttgaggcctttaaacatggaagatatgagacaagctaagaatcaggttgctgctagctttgcttctgaaggatcagtaatggctgagctgaaacaatggaatgaattatatggagaaggaggttcaaggaagaagcaacagttgacttacttcctctagatttgtagaaaaaagcaaaggttttcttacaaaaccgatacaataacacccttcaacgaaaacagaatcatttccggtttgggtcattacacgacatagcatcaaagatcaaaggttccggtacgggtcaccatatacaacagtgtttgaaagtatatatacgtggcatttgtacaagggggttcattggcatcaatcttggggtattttcgttgtgtttatgtgaaagtatgtagtaattataaggtattaggaaatgcctacgagttttatattggactgcttgagattctgtagtttaggttataatatatataatattgtctaaaagaagtatttgtacgaccatgtcgcataatctttgatagaatattttaatttcctgtaatgttggactacgttttcatgcanatttgccaatgagtagttttctggaaatgaaagcaaaaaatagttaaat

SEQ ID NO: 523 - protein, 92 aa, Arachis hypogaea
WGVSLPEGKQKTLFSFSGDIVLSSNRFRPSHLPATMTTSRRLADRKVEKFEKNITKRGFVPETNTKKGKDYPVGPVLLGFFVFVVIGSSIFQ

SEQ ID NO: 524 - protein, 50 aa, Nicotiana tabacum
ADRKIERFEKNITKRGAVPETTAKKGNQYPVGPILLGFFVFVVIGSSLFQ

SEQ ID NO: 525 - protein, 218 aa, Nicotiana tabacum
RKKKPQGRFYLEEGKTKKKMIKGFMNQQNQPVVVEENMSNLTSASGEAASVSSCNRNDNNTTGGIYPPQYNFAPPNQQIQAQHQIKKKRNQPGNPDPGAEVIALSPKTLMATNRFVCEICNKGFQRDQNLQLHRRGHNLPWKLKQRTSKEIRKKVYVCPEPSCVHHDPSRALGDLTGIKKHFCRKHGEKKWKCEKCSKKYAVQSDWKAHSKTCGTKEY

SEQ ID NO: 526 - protein, 76 aa, Nicotiana tabacum
KPKPAPPSDAAAEAADEASEEHKSNSNSSSESSSLTATTTAAAAANTSGAATAEVVSAASSNSASTFLNFHESNFF

SEQ ID NO: 527 - protein, 107 aa, Nicotiana tabacum
SKPKSSTLPSNAAAEAADAASEERKSNSNSSSESSSLTATTPAAAAANTTGSATAEVVSAASSNSASTFLNFHESNFFLPNSTNQSFDHQPLMDHSADGQIFQDIGN

SEQ ID NO: 528 - protein, 68 aa, Hordeum vulgare
MTTSRRLADRKSAKFQKNITKRGSVPETTVKKGNDYPVGPIVLGFFIFVVIGSSLFQIIRTATSGGMA

SEQ ID NO: 529 - protein, 119 aa, Hordeum vulgare
VIRIMRRVLPPHAKISDDAKETIQECVSEYISFITGEANERCQREQRKTITAEDVLWAMSRLGFDDYVEPLSIYLHRFREFEGEARGAGVGHHHHGMPPMMLKPRGAPGPMVPHGDMQM

SEQ ID NO: 530 - protein, 142 aa, Hordeum vulgare
  misc_feature (68)..(68): Xaa can be any naturally occurring amino acid
GGGAMGRPPCCDKVGVKKGPWTPEEDLMLVSYIQEHGPGNWRAVPTNTGLMRCSKSCRLRWTNYLRPXIKRGNFNDQEEKLIVHLQALLGNRWAAIASYLPERTDNDIKNYWNTHLKKKLKKMQDAGGGGHDGGSEGAGVTK

SEQ ID NO: 531 - protein, 70 aa, Hordeum vulgare
LWDNSCRREGQSRKGRQVYLGGYDKEEKAARAYDLAALKYWGSSTTTNFPVADYEKEVEEMKHMTRQEFV

SEQ ID NO: 532 - protein, 110 aa, Hordeum vulgare
  misc_feature (97)..(97): Xaa can be any naturally occurring amino acid
  misc_feature (100)..(100): Xaa can be any naturally occurring amino acid
QPAAPFPANPAQLNAQNQLIYEQAQQCNQQLQQQQQSQLQQFLAERLSEIEQDTDFKNHTLPLARIKKIMRADEDVRMISAEAPVVFAKACEIFILXLTXRSWMHTEENK

SEQ ID NO: 533 - protein, 68 aa, Prunus persica
MTTSRRLADRKVEKFEKNITKRGAVPETTAKKGKDYPVGPILLGFFVFVVIGSSLFQIIRTATSGGMA

SEQ ID NO: 534 - protein, 153 aa, Thellungiella halophila
SVTVTVAVSFLALFISLVTVSADVIKLPSQASKFFRTTKHNDDGDSSAGTKWAVLVAGSSGYWNYRHQADVCHAYQLLRKGGLKEENIIVFMYDDIAKNKENPRPGIIINSPNGNDVYNGVPKDYTGDDVNVDNLFAVILANKTALKGGSGKV

SEQ ID NO: 535 - protein, 171 aa, Thellungiella halophila
SLPHKEEGLKMSSSSSYNTSVVPSSSSSAQPFFITGSGAGDNDFDRKDTFMSMIQQPISSAPPAKKRRNQPGNPNPDAEVVALSPKTLMATNRFVCDVCNKGFQREQNLQLHRRGHNLPWKLKQKSTKEVKRKVYLCPEPTCVHHDPSRALGDLTGIKKHYYRKHGEKKWK

SEQ ID NO: 536 - protein, 100 aa, Thellungiella halophila
METKWLFTSAFSQMFGYSNRMDQTSNCQNTRNKIMMMKKEEFPSGFQVPLHYPKYSKSDYEAMDDLSLDLLLKQYGLSFEGSLDDKRVFAIESFLWPDQL

SEQ ID NO: 537 - protein, 49 aa, Fragaria x ananassa
KVERFEKNITKRGAVPETTAKKGKDYPVGPILLGFFIFVVIGSSLFQII

SEQ ID NO: 538 - protein, 57 aa, Brassica napus
VKRIVMVMMAGFGSGFVYYGIQLNAENLNFNLYLTVAVNAMMEFPAVFIGSFLLGVM

SEQ ID NO: 539 - protein, 247 aa, Brassica napus
  misc_feature (173)..(173): Xaa can be any naturally occurring amino acid
AEYINAGLYLFATVVLIGGFTATGFSWEPRSGLVLILLALALITAVNVHDLVAHLAGIDYRLKLMEYDLQLGLVEFAVPLVQIAGSVVFFLGILFVFNQAETKHGNSGREKHALNMLIAGPLLWVIGSIHNSCQIYERADSHVQILQQCVHIPFLVGSLLFLVSSLLNSFDQXGSSHTALKLLGRRWIWLGLSGSICLFVGGLMNVVKVFNFVQITGLRLEKLRGGAQDRLLEEREGYLPLVAEKKK

SEQ ID NO: 540 - protein, 186 aa, Brassica napus
MAMEAGMKPLILVAYRQIFASIATLPVAFFLERKTIPKITMRVLVQAFFCSITGVTGNQVLYFIGLQNSSPTIACALTNLLPAVTFLLAAIFRQESVGIRKVSGQAKVIGTVVCVAGAMLLSFYHGHTIGIGESKIHWTYAQNITAHGSDSAGSNFFLGPFLIMAAAVSCAGWFIIQTKMSETFAA

SEQ ID NO: 541 - protein, 272 aa, Brassica napus
MGKRRGVSAVNVVFGWLRKQSKKVKIALGVILSLLLVVFLKFTVKNYNHFFIASELIHAAGIIILIYKLTRQKTCSGLSLKSQEVTAVFLAVRLICSINMEGDIHTVLDFATLVSTLWVIYMIRFTLKASYIKTLDTCHNYYVLVPSAILALIIHPKTSYNYIHSVMWAFCVYSESVSVLPQLRLMQNAQIIEPFTAHYVFALGIARFLACAHWLIQVFETRGRYLWLIGAGYFWFPVALVAELIQTFILADFCYYYVKSVMEGQLVLKMPV

SEQ ID NO: 542 - protein, 125 aa, Brassica napus
IILSLILVVFLRFTVKNHNHFFVASELIHAAGIIILIYKLTRQKTCSGLSLKSQEVTAVFLAVRLICSISMEGDIHTVLDFATLVSTLWVIYMIRFKLKASYVKTLDNCHHYYVLVPSAILAFII

SEQ ID NO: 543 - protein, 272 aa, Brassica napus
MGKRRGVSAVNVVFGWLRKQSKKVKIALGVILSLLLVVFLKFTVKNYNHFFIASELIHAAGIIILIYKLTRQKTCSGLSLKSQEVTAVFLAVRLICSINMEGDIHTVLDFATLVSTLWVIYMIRFTLKASYIKSLDTCHNYYVLVPSAILALIIHPKTSYNYIHSVMWAFCVYSESVSVLPQLRLMQNAQIIEPFTAHYVFALGIARFLACAHWLIQVFETRGRYLWLIGAGYFWFPVALVAELIQTFILADFCYYYVKSVMEGQLVLKMPV

SEQ ID NO: 544 - protein, 86 aa, Brassica napus
LFKRISLSILSTSLSGSMAASVDPLVVGRVIGDVLDMFIPTANMSVYFGPKHITNGCEIKPSAAVNPPKVSISGNSNELYTLVMTD

SEQ ID NO: 545 - protein, 174 aa, Brassica napus
MAAASVDPLVVGRVIGDVLDMYIPTANMSVYVGPKHITNGCEIKPSVAVNSPKVNISGNSDELYTLVMTDPDAPSPSEPNMREWVHWIVVDIPGGTNPSKGKEILPYMEPKPPVGIHRYIFVLFRQISPVGLMVQQPPSRANFSTRMFAGHLDLGLPVATVYFNAQKEPASRRR

SEQ ID NO: 546 - protein, 125 aa, Brassica napus
KKIKITMAHILNTQHLLTTSGKKRNDRDDEDGVSTVAKKSSLMACEADPAVALASIRHEFGEHGGVNMSIEASATFTVMEPDTMRRMFAGELGPENDFFVYSRHFNPTVLNLSRQMAALEGTQAA

SEQ ID NO: 547 - protein, 68 aa, Brassica napus
MTTSKRLADRKIEKFDKNITKRGFVPETTTKKGKDYPVGPILLGFFVFVVIGSSLFQIIRTATSGGMA

SEQ ID NO: 548 - protein, 99 aa, Brassica napus
KTYNSNKYISSWENKNKTKKCFFFSLQLDRDHSVFFSGVIMTTSKRLADRKIEKFDKNITKRGFVPETTTKKGKDYPVGPILLGFFVFVVIGSSLFQII

SEQ ID NO: 549 - protein, 68 aa, Brassica napus
MTTSKRLADRKIEKFDKNITKRGFVPETATKKGKDYPVGPILLGFFVFVVIGSSLFQIIRTATSGGMA

SEQ ID NO: 550 - protein, 83 aa, Brassica napus
MKGYSHADRVKRKEFLDYSRIQKHICKGYDLFDMLPEEYSFKDLISKIGPIPPSASAVHLPAFLIQNAARFRFLLPGGCLREP

SEQ ID NO: 551 - protein, 323 aa, Brassica napus
  misc_feature (23)..(23): Xaa can be any naturally occurring amino acid
  misc_feature (151)..(151): Xaa can be any naturally occurring amino acid
  misc_feature (166)..(166): Xaa can be any naturally occurring amino acid
MSIPQAKMELRPLGNTGLKVSSXGFGASPLGSVFGPVAEVDAVATVREAFRQGINFFDTSPYYGGTLSEKMLGKGLKALQVPRSDYIVATKCGRYEEGFDFSAERVTKSIDESLERLQLDYVDILHCHDIEFGSLDQIVSETIPALQKLKXEGKTRFIGITGLPLXIFTYVLDRVPPGTVDVILSYCHYGVNDSTLVDLIPYLKGKGVGVISASPLAMGLLTEQGGPEWHPASPELKSACKAAAAHCKSKGKKITKLALQYSLANKEISSVLVGMSSVSQVEENVAAVRELEDLGMDQETLSEVEAILEPVKNQTWPSGVDQK

SEQ ID NO: 552 - protein, 142 aa, Brassica napus
DAVIQEAEKVKGRDSLYIGNINFYHKPLRTGKWAVTYEEWPEESYPPYANGPGYILSYDIAKFIVDDFEQQRLRLFKMEDVSMGMWVEKFNETRPVAVVHSLKFCQFGCIEDYFTAHYQSPRQMICMWDKLQRLGKPHCCNL

SEQ ID NO: 553 - protein, 78 aa, Brassica napus
FKGIFGMKKSKEKEYRVSGDGGGEAGESLIHRKVLQADNLWLRTYLAETDKEQNKHAIAVAAATAAAADAAVAAAQAA

SEQ ID NO: 554 - protein, 123 aa, Brassica napus
KISKAKAIFTQDEIIRGDKRIPLYRRVVDAEAPLAIVIPARGSFVRMNLRENDLSWNDFLGKAGNMRGVEYIAVEKPAGACTNILFSSGTTGDPKAIPWTNISPLKSAADAWCHLDAHQGDVV

SEQ ID NO: 555 - protein, 113 aa, Brassica napus
KRVMVVVDETSRSKHAMMWALTHLTNKGDLMTLLHVVSPHDEASPSLVQSLGSLCKACKPEVDVEALVIQGPKLATVLSQVKKLEVTVLVLGQKKSAPFISCLCGPSRSEELV

SEQ ID NO: 556 - protein, 466 aa, Brassica napus
MRNLYFLVLFPLSILILVDASLHVKYLPGLEGPLPFELETGYVSVGESGDVELFYYFVKSERNPDKDPLMIWLTGGPGCSSICGLLFANGPLAFKGDEYNGTLPPLELTSFSWTKVANILYLESPAGSGYSYAKTRRAAETSDTKQIHQIDQFLRSWFVDHPEFISNSFYVGGDSYSGKIVPGVVQQISLGNEKGLAPLINIQGYVLGNPAVRTNLEPNHRVSFAHRMGLISDELHESLERNCGGKFFNVDPSNAKCSNGLLAYHQCISEIYIEQILLPNCKVDYVLADISQTLPNIRTSRRRELKEFSRNDSSSLPPPSCFTYRYFLSAFWANDENVRRALGVKKGFGKWSRCNTQNIPYTYDIHNAIPYHVNNSRKGFRALIYSGDHDMMIPFSSTEAWIKSLNYSIVDDWRPWMMNSNQVAGYTRTYANKMTFATIKGGGHTAEYNPDQCSLMFKRWIDGESL

SEQ ID NO: 557 - protein, 141 aa, Brassica napus
AYQLLRKGGVKEENIVVFMYDDIAKNKENPRPGIIINSPNGDDVYNGVPKDYTGDDVNVDNLFAVILGNKTALKGGSGKVVDSGPNDHIFIYYSDHGGPGVLGMPTSPALYANDLNDVLKKKHASGTYKSLVFYLEACESG

SEQ ID NO: 558 - protein, 229 aa, Brassica napus
MSFTGTLDKCKACDKTVYVMDLLTLEGNTYHKNCFRCSHCNGSLVISNYSSMDGVLYCKRHFEQLFKESVKSLHTGGKTDKTNDQLTRAPSKLSSFFSGTQDKCATCQKTVYPLEKVTMEGECFHKTCFKCAHSGCPLTHSSYASLNGVLYCKVHFNQLFLEKGSYNNVHQAAANHRRSASSGASSPPHDNHKPEDEAVAPEGEEGEGKEEEEEAAPEAAGEEPEPKAE

SEQ ID NO: 559 - protein, 454 aa, Brassica napus
MAFYFRRLCYFPALLLVVIQLLHGVCGQLVVVEEPTYAPPPPLVVIEEPTSSPPPPLDVVNEPIFAPPPPLDVVNEPISAPPPPLNVVEEPLSAPPPPLHVVEEPISAPPPPLVKQDGNDAIVPALFVFGDSLIDNGNNNNIPSFAKANYFPYGIDFNGGPTGRFCNGLTMVDGIAQLLGLPLIPAYSEAIGDQVLRGVNYASAAAGILPDTGGNFMGRIPFDQQIHNFQTTLDQMASKSGGPVAIADSVARGLFFIGMGSNDYLNNYLMPNFPTRNQFNAHQFGDLLVQHYANHLTRLYNLGGRKFVVAGLGRMGCIPSILAQGTDGKWSEEVNQLVLPFNTNVKTMISNLNQNLPAAKFIYIDITHMLEDIIANPAIYGVTTLDKGCCGIGRNRGQITCLPFETPCPNRDQYLFWDAFHPTEKVNLVMAKKAFAGDRTVAFPINIQELASLS

SEQ ID NO: 560 - protein, 227 aa, Brassica napus
  misc_feature (215)..(215): Xaa can be any naturally occurring amino acid
MSFTGTLDKCKACDKTVYVMDLLTLEGNTYHKNCFRCSHCNGSLVISNYSSMDGVLYCKRHFEQLFKESVKSLHTGGKTDKTNDQLTRAPSKLSSFFSGTQDKCATCQKTVYPLEKVTMEGECFHKTCFKCAHSGCPLTHSSYASLNGVLYCKVHFNQLFLEKGSYNNVHQAAANHRRSASSGASSPPHDNHKPEDEAVAPEGEEGEGKEEEEEXAPEAAGEEPKAE

SEQ ID NO: 561 - protein, 45 aa, Brassica napus
SKSHEKYEIFAEGLPGFPDNIKRSPRGGFWVGLNTKHSKLTKFAM

SEQ ID NO: 562 - protein, 133 aa, Brassica napus
DVLQVAGFYNKAPQFRFICRRNVVLSIDLDKTNEEDLHRSITLAKKKLENKAFLAEYTSYADTSSVPGHYVLFWEIQWLEPDDEEEKLLMEECCIAVEEELDYIYRQCRKRDRSVGPLEIRVVKPGTFEKLMD

SEQ ID NO: 563 - protein, 205 aa, Brassica napus
MYHSHESLQFSLEKSISNLKDMRLSFTIQSLAFVPLFVVVVHAVVIAAEDGNSPEEAMFPAMFVFGDSLVDNGNNNRLNSLARSNYLPYGIDFDGGQPTGRFSNGKTIVDFIGELLGLPDIPAFMETMDGGVDVLRGVNYASAAGGILEETGRHLGERFSMRRQVENFDKTLMEISRGIGSVTEYMAKSLVVVSLGNNDYINNYL

SEQ ID NO: 564 - protein, 113 aa, Brassica napus
MAALDYLVAVESDIFVPTNDGNMARVVEGHRRFLGFKKTIQLNRKFLVKLIDEYTEGLLTWDVFSSMVKAFHSTRMGSPKRRLVIPNKPKEEDYFYTNPQECLQLLDEPLRVI

SEQ ID NO: 565 - protein, 191 aa, Brassica napus
MPLKHSSPDTISSSSDSVRLLSRETLRISASLASPPDDLLPQALPDSSHFLRSTLRLICCEEIDGRRWKYVAESDGSGKFKRNSVVRAVSLESPRTPFDEVGSFLRSYVVPEGFPASVNESYVPYMTFRALKHFFGGAMGVFTTQTLLNSVGASRNSSDSAAVAINWILKDGAGRVGKMLFARQEKKFDYD

SEQ ID NO: 566 - protein, 302 aa, Brassica napus
FKGGHKWNKRASSFPPPQTSSFFLRSLTRMPLKHSSPDPISSSDSIRLLSRETLRISASLAAPPDDLLPQALPDSSQFLRSTLRLICCEEIDGRRWKYVAESDGSGKFKRNSVVRAVSLESPRTPFDEVGSFLRSYVVPEGFPASVNESYVPYMTFRALKHFFGGAMGVFTTQTLLNSVGASRNSSASAAVAINWILKDGAGRVGKMLFARQGKKFDYDLKQLRFAGDLLMELGAAVELGTAAVPHLFLPLACAANVVKNVAAVTSTSTRTPIYKAFAKGENIGDVTAKGECVGNIADLMGT

SEQ ID NO: 567 - protein, 297 aa, Brassica napus
KWNKRASSFPPPQTSSFFLRSLTRMPLKHSSPDPISSSDSIRLLSRETLRISASLAAPPDDLLPQALPDSSQFLRSTLRLICCEEIDGRRWKYVAESDGSGKFKRNSVVRAVSLESPRTPFDEVGSFLRSYVVPEGFPASVNESYVPYMTFRALKHFFGGAMGVFTTQTLLNSVGASRNSSASAAVAINWILKDGAGRVGKMLFARQGKKFDYDLKQLRFAGDLLMELGAAVELGTAAVPHLFLPLACAANVVKNVAAVTSTSTRTPIYKAFAKGENIGDVTAKGECVGNIADLMGT

SEQ ID NO: 568 - protein, 271 aa, Brassica napus
LISSLQSIKLFTSPIIRIADLGCATGSNTFDTVDTVVETLRQLFTAVYGGGSLEFEAFFCDLPSNDFNMLFRLLSEKQKVDSAKYFASGVAGSFCDRLFPRGTIHVAVSLSALHWLSQIPEKVLEKGSRTWNKGKTWIEGAKKEVVDAYAEQSDKDLDDFLKCRKEEMVEGGVLFVLMGGRPSGSSSQFGDQDTRAKHPFTTTMEQAWQDLIDEGSIDEETRDGFNIPAYMRSPEEVAAGIDRIGGFKIEKMEYMKIVESSDEKHEEWKKD

SEQ ID NO: 569 - protein, 579 aa, Brassica napus
  misc_feature (23)..(23): Xaa can be any naturally occurring amino acid
  misc_feature (30)..(30): Xaa can be any naturally occurring amino acid
  misc_feature (63)..(63): Xaa can be any naturally occurring amino acid
  misc_feature (82)..(82): Xaa can be any naturally occurring amino acid
  misc_feature (117)..(118): Xaa can be any naturally occurring amino acid
  misc_feature (158)..(158): Xaa can be any naturally occurring amino acid
  misc_feature (177)..(177): Xaa can be any naturally occurring amino acid
  misc_feature (179)..(179): Xaa can be any naturally occurring amino acid
  misc_feature (182)..(182): Xaa can be any naturally occurring amino acid
  misc_feature (284)..(284): Xaa can be any naturally occurring amino acid
MNNNWLGFSLSPYEQNHHRKDVXSSTTTTXVDVAGEYCYDPTAASDESSAIQTSFPSPFGVVXDAFTRDNNSHSRDWDINGXACNNIHNDEQDGPKLENFLGRTTTIYNTNENVGDXXGSGCYGGGDGGGGSLGLSMIKTWLRNQPVDNVDNQENGNXAKGLSLSMNSSTSCDNNNXSXNNXVAQGKTIDDSVEATPKKTIESFGQRTSIYRGVTRHRWTGRYEAHLWDNSCKREGQTRKGRQVYLGGYDKEEKAARAYDLAALKYWGTTTTTNFPMSEYEKEXEEMKHMTRQEYVASLRRKSSGFSRGASIYRGVTRHHQHGRWQARIGRVAGNKDLYLGTFGTQEEAAEAYDIAAIKFRGLTAVTNFDMNRYNVKAILESPSLPIGSAAKRLKEANRPVPSMMMISNNVSESENSASGWQNAAVQHHQGVDLSLLHQHQERYNGYYYNGGNLSSESARACFKQEDDQHHFLSNTQSLMTNIDHQSSVSDDSVTVCGNVVGYGGYQGFAAPVNCDAYAASEFDYNARNHYYFAQQQQTQQSPGGDFPAAMTNNVGSNMYYHGEGGGEVAPTFTVWNDN

SEQ ID NO: 570 - protein, 59 aa, Brassica napus
MNLEFTEAEFFLKASTGKGLDAFNATLAKGGPPPIGAKKANLDPITNRIIEEFGYQEIG

SEQ ID NO: 571 - protein, 367 aa, Brassica napus
GDVAELKKLYKDKFWKASDKMVDYLRSSIGIIHRNHAESITTFIKESVDDELKEPNVNVKKRLTFCVEGNISVGKSTFLQRIANETIELRDLVEIVPEPVDKWQDVGPDHFNILDAFYSEPQRYAYTFQNYVFVTRLMQEKESASGIKPLRLMERSVFSDRMVFVRAVHEAKWMNEMEISIYDSWFDPVVSALPGLVPDGFIYLRASPDTCHKRMMLRKRAEEGGVSLKYLQDLHEKHESWLLPFESGNHGVLSVSKPSLQMDNSLHPDIKDRVFYLEGNHMHSSIQKVPALVLDCEPNIDFSRDVEAKRQYARQVAEFFEFVKKKQETSQENSSPLLMPPHNGGLWMGPEGKHVPGLELPSLDFRK

SEQ ID NO: 572 - protein, 327 aa, Brassica napus
GDVAELKKLYKDKFWKASDKMVDYLRSSIGIIHRNHAESITTFIKESVDDELKEPNVNVKKRLTFCVEGNISVGKSTFLQRIANETIELRDLVEIVPEPVDKWQDVGPDHFNILDAFYSEPQRYAYTFQNYVFVTRLMQEKESASGIKPLRLMERSVFSDRMVFVRAVHEAKWMNEMEISIYDSWFDPVVSALPGLVPDGFIYLRASPDTCHKRMMLRKRAEEGGVSLKYLQDLHEKHESWLLPFESGNHGVLSVSKPSLQMDNSLHPDIKDRVFYLEGNHMHSSIQKVPALVLDCEPNIDFSRDVEAKRQYARQVAEFFEFVKKKQ

SEQ ID NO: 573 - protein, 225 aa, Brassica napus
MASSSSSAALYRISNLQNHISPLEANNKLRSLVKISPQVSEAISSGRAVVALESTIISHGMPYPQNLQTAKEVESIVRENGAVPATIAILNGVPCIGLNEDELERLASLGKGVQKTAGRDIAYVVATRGNGATTVSATLFFASMVGIQVFVTGGIGGVHRHANQTMDISSDLTALGRTPIAVISAGVKSILDIPKTLEYLETQEVYVAAYKSDEFPGIFHRKKRV

SEQ ID NO: 574 - protein, 89 aa, Brassica napus
SVIQREMASSSSSLSRISTLQNHISPLEANNKLRSLVKISPQVSEAISSGRAVVALESTIISHGMPYPQNLQTAKEVESIVRENGAVPA

SEQ ID NO: 575 - protein, 285 aa, Brassica napus
MASLKIPANVPLPEEDSEQLHKAFKGWGTNEGMIISILAHRNAAQRSLIRAVYAANYNKNLLNELDKELSGDFERAVMLWTLEPVERDAYLAKESTKMFTKNNWVLVEIACTRPALEFFKAKQAYQARYKTSLEEDVAYHTSGDIRKLLVPLVSTFRYDGNADEVNMKLASSEAKTLHKKITEKAYTDEDLIRILTTRSKAQIMATLNHFKDKFGSSINKYLKEDSEDEYVQLLKTTIKCLTYPEKYYEKVLRRAINKVGTDEWALTRVVTTRAEVDMERIKEEY

SEQ ID NO: 576 - protein, 100 aa, Brassica napus
MEMKWLLTSAFTQMFGYSNQISQTSNSLSTRNKIKMMKKEEYPRGFQVPLHYPKYSKSDYEAMDDLSLDLLLKQYGISFEGSLEDKRVFAMESFLWPDQL

SEQ ID NO: 577 - protein, 48 aa, Brassica napus
MLRFYTDEAPGLKISPTVVLIMSLCFIGFVTALHVFGKLYLHKSGSKA

SEQ ID NO: 578 - protein, 218 aa, Brassica napus
KNIKKMEEEMKKKQGKGELEGEAQKCPRCESPNTKFCYYNNYSLSQPRYFCKSCRRYWTKGGTLRNVPVGGGCRRNKRSSSSFSKNINKPINFHNDPLHNPLITGMPSPFSYDSIDLNLAFAALHKHPPSQVTPSFGFGGDVSIYGNSTNTHTGVLNGLNIGGQNGNFNGGSLWYGFMSGNDSENKTTSALGIPLEGNERKQENVNNNNNILENPSKV

SEQ ID NO: 579 - protein, 47 aa, Cucumis melo
KVERFEKNILKRGAVPETATKKGKDYPVGPILLGFFVFVGIGSSLFQ

SEQ ID NO: 580 - protein, 210 aa, Saccharum officinarum
STSTNNWLGFASFSGAADAVLHPLPPQGEADAEAPMLEDFLGLQEPTAPVAARPFAGSGASSIGLSMIKNWLRSQPAPAPAGVDSMALATTATSPERSRKVVDGGESGGIILVDTAQQRKASVDTFGQRTSIYRGVTKHRWTGRYEAHLWDNSCRREGQTRKGRQVYLGGYDKEEKAARAYDLAALKYWGTTTTTNFPMSNYEKELEEMK

SEQ ID NO: 581 - protein, 50 aa, Saccharum officinarum
GGYDKEDKAARAYDLAALKYWGTTTTTNFPISNYEKELEEMKHMTRQEYI

SEQ ID NO: 582 - protein, 173 aa, Brassica rapa
MAASVDPLVVGRVIGDVLDMFIPTANMSVYFGPKHITNGCEIKPSAAVNPPKVNISGNSNELYTLVMTDPDAPSPSEPNMREWVHWIVVDIPGGTNPSKGKEILPYMEPRPPVGIHRYIFVLFRQNSPVGMMVQQPPSRANFSTRMFAGHLDLGLPVATVYFNAQKEPASRRS

SEQ ID NO: 583 - protein, 70 aa, Brassica rapa
MKCDDDTFVRVDAVIQEAEKVKGRDSLYIGNINFYHKPLRTGKWAVTYEEWPEESYPPYANGPGSSCHMT

SEQ ID NO: 584 - protein, 211 aa, Brassica rapa
EKMRNIYFLVLFLLSILISIHASLHVKYLPGLEGPLPFELETGYVSVGESGDVELFYYFVKSERNPDKDPLMIWLTGGPGCSSICGLLFGNGPLAFKGDVYNGTVPPLELTSYSWTKVANILYLESPAGSGYSYAKTRRAAETSDTKQLHQIDQFLRSWFVDHPEFISNPFYVGGDSYSGKIVPGVVQQILLGNEKGLTPLINIQGYVLGN

SEQ ID NO: 585 - protein, 107 aa, Brassica rapa
KRINPTNLTFKLKQLYTMAFHFRRLCMSSALLVVVLQILHGVSGQLVVVEDPVSASPPPLVEQDGSDGIVPALFVFGDSLIDNGNNNNIPSFAKANYFPYGIDFNGG

SEQ ID NO: 586 - protein, 207 aa, Brassica rapa
GEPSIFLGKNISNLKDMRKSFTIQSLAFVPLFVVVVHAVVIAAEDENEAMFPAMFVFGDSLVDNGNNNRLNSLARSNYLPYGIDFDGGQPTGRFSNGKTIVDFIGELLGLPDIPAFMETMDGGVDVLRGVNYASAAGGILEETGRHLGERFSMRRQVENFDKTLMEISRGIGSSVTEYMAKSLVVVSLGNNDYINNYLKPSAFPHQL

SEQ ID NO: 587 - protein, 152 aa, Brassica rapa
MGALNFLSGYFSDHFYVSIRKRKKRKVMQTVNIKVKIDCDGCERKIKNAVSSMKGAKSVEVNRKMHKVTVSGYVDPKKVLKKVQSTGKKKAELWPYVPYTMVAYPYAAGAYDKRAPPGFVRKSEQAQAQPGGTDDKLMSLFSDENPNACTIM

SEQ ID NO: 588 - protein, 133 aa, Brassica rapa
KKKMGRPPCCEKTGVKKGPWTPEEDIVLVSYIQEHGPGNWRSVPTNTGLRRCSKSCRLRWTNYLRPGIKRGNFTEHEEKMIVHLQALLGNRWAAIASYLPERTDNDIKNYWNTHLKKKLKKINESGEEDYDDF

SEQ ID NO: 589 - protein, 203 aa, Brassica rapa
  misc_feature (159)..(159): Xaa can be any naturally occurring amino acid
FCKKNMMGFSKELEGTWLNLYVVVVSLMVLELIVVVKAQLVPSMFIFGDSVVDVGNNNHIYTIVKANFPPYGRDFTTHTPTGRFCNGKLATDFTAENLGFTSYPQAYLSKKAKGRNLLIGANFASAASGYYDGTAKLYSAISLPQQLEHYKDYINRIQXIATSNNANATSIISDGIYVVSAGSSDFIQNYYINPLLYKVQSPD

SEQ ID NO: 590 - protein, 64 aa, Brassica rapa
KAARAYDLAALKYWGPSTHTNFSVENYQKEIDDMKNMTRQEYVAHLRRKSSGFSRGASIYRGVT

SEQ ID NO: 591 - protein, 114 aa, Brassica rapa
LESDKWRWDELEDDDRAAEEASVLWCRKLALYAIFFSLSLSLSLSPSHITQKSPWLLLHPLMLPSLEFEKKIKLTFFLRIPPRPSLLLLTTSHRSLSNLLKLHRRKRREINQEL

SEQ ID NO: 592 - protein, 190 aa, Brassica rapa
PNQKIKNQIFTLSSPASTNSERMDQQEHAQSGAMNYGSNPYQTNPMSTTSAGPAAPPGQLGFHQIHQQQQQQQLAQQLQVFWENQFKEIEKTTDFKNHSLPLARIKKIMKADEDVRMISAEAPVVFARACEMFILELTLRSWNHTEENKRRTLQKNDIAAAVTRTDIFDFLVDIGPREDLRDEGLGEYSE

SEQ ID NO: 593 - protein, 74 aa, Brassica rapa
FLQPFVAWMDPQQEMSNETLETILVSSTKGSNYKNIKKMEEEMKKKQGKGELEGEAQKCPRCESPNTKFCYYNN

SEQ ID NO: 594 - protein, 338 aa, Zea mays
  misc_feature (327)..(327): Xaa can be any naturally occurring amino acid
MRHTVYLGGYDTEDKAARAYDLAALKYWGPATHVNFPVENYRDELEEMKGMTRQEFVAHLRRRSSGFSRGASIYRGVTRHHQQGRWQSRIGRVAGNKDLYLGTFTTQEEAAEAYDIAAIKFRGLNAVTNFDIARYDVDKIMESSTLLAVEEARKVKAVEAASSAPMTHTHSGGKEQLNATTAEETSSAGWRMVLHGSPHQLEAARCPEAADLQSAIMNNDSHPRPSLHGIAGLDIECAVHDHHDHLDVPAGSRTTAAGSINFSNSSSQVTSLGNSREGSPERLGLAMMYGKQPSSAVSLAATMSPWTPVAAQTVAHVLKQQPNVVVXHRPVFAAWADA

SEQ ID NO: 595 - protein, 235 aa, Zea mays
  misc_feature (33)..(33): Xaa can be any naturally occurring amino acid
MYRGVTRHHQHGRWQARIGRVSGNKDLYLGTFXTQEEAAEAYDVAAIKFRGLNAVTNFDLTRYDADRIMASSTLLPPDLARRRKDDDPDCGVTAAAAALVQQAAAAAAAAAPPPPPRDGSQHQHHHDVLSGEACFSVLHDLVATAADGGHHHSNAAQHVPVSSAASSLLTSIGNGNYREGSPDRGLSMLFSKPPPAHAASAKPVSPLGSWASTAASARAAVSIAHMPVFAAWTDA

SEQ ID NO: 596 - protein, 338 aa, Zea mays
MRHTVYLGGYDTEDKAARAYDLAALKYWGPATHVNFPVENYRDELEEMKGMTRQEFVAHLRRRSSGFSRGASIYRGVTRHHQQGRWQSRIGRVAGNKDLYLGTFTTQEEAAEAYDIAAIKFRGLNAVTNFDIARYDVDKIMESSTLLAVEEARKVKAVEAASSAPMTHTHSGGKEQLNATTAEETSSAGWRMVLHGSPHQLEAARCPEAADLQSAIMNNDSHPRPSLHGIAGLDIECAVHDHHDHLDVPAGSRTTAAGSINFSNSSSQVTSLGNSREGSPERLGLAMMYGKQPSSAVSLAATMSPWTPVAAQTVAHVLKQQPNVVVFHRPVFAAWADA

SEQ ID NO: 597 - protein, 388 aa, Zea mays
MVFPSVPVYLDPHPPDWNNQQQQGQQPRASGGADAPLLPVGPMAATAAASEPGGLPRSSSTSSAALAMHARPNSMAERARLARLPNPEPALKCPRCESTNTKFCYYNNYSLSQPRHFCKTCRRYWTRGGSLRNVPIGGGCRRNKRSSKSSAAGSSSSSKPFSSGRLLGGPSAMSSTTQGATGAIIAPGLSSFSHHLPFLGSMHPPGPNLGLGFSVGLPLLGMQHLEMVDQFPVASGGGTTIGASLEQWRVQQQQQQQFPFMTRGILDLPQPSTYQLGLEASRGGSGSDAVAFTLGQSTTSAATITTRQEGSAMKMGDDSKGQDASLQKQYTAALHHGSGSHGVWDGNAGGSGSGGGGGTGSGNSSWPMNIVSAFHSSSTSGGNGDGLS

SEQ ID NO: 598 - protein, 194 aa, Prunus dulcis
MAASSSSVAPLFGIREEDQNQQMKQQHSSTPPTSSTAAAAAPPQKKKRNQPGTPNPEAEVIALSPKTLMATNRFICEVCNKGFQREQNLQLHRRGHNLPWKLKQKTTKEPKRKVYLCPEPTCVHHDPSRALGDLTGIKKHFSRKHGEKKWKCEKCSKRYAVQSDWRPILTLVGLENPMGLWHSLLKEGPVYHAP

SEQ ID NO: 599 - protein, 195 aa, sorghum bicolor
EADLFKGGLLKPCGGILLFGPPGTGKTMLAKAIANDAGASFINVSMSTITSKWFGEDEKNVRALFSLAAKVAPTIIFVDEVDSMLGQRARYGEHEAMRKIKNEFMSHWDGLLSKTGERILVLAATNRPFDLDEAIIRRFERRIMVGLPTQESRELILRTLLSKEKIEENIDFKELATMTEGYSGSDLKNLCVTAA

SEQ ID NO: 600 - protein, 390 aa, sorghum bicolor
VDMDSDEELDDRLTVLFPYNIEIKPPENENHLVSWNSQLEEDMKMIQFQDNRNHIMEVLAENDLECDDLGSICLSDTMCLSKYIEEIVVSAVSYHLMNNRDPEYRNGKLVLSTKSLSHALEIFQGNKMGDKDSMKLEVTDGALKAAEKAIAPATAKSETKPATLLPPVRPPAGAAAAAPSSAPAPRVESKTEPEKKDNPPPVAKALEVPPDNEFEKRIRPEVIPANEIGVSFDDIGALDDIKESLHELVMLPLRRPDLFKGGLLKPCRGILLFGPPGTGKTMLAKAIANEAQASFINVSMSTITSKWFGEDEKNVRALFTLAAKVSPTIIFVDEVDSMLGQRNRAGEHEAMRKIKNEFMTHWDGLLSRPDQRILVLAATNRPFDLDEAII

SEQ ID NO: 601 - protein, 131 aa, sorghum bicolor
GNKDLYLGTFSTQEESAEAYDIAAIKFRGLNAVTNFDISKYDVKRICASTHLIGGGDACRRSPTQPPDAPALAIDAAGADRSSHAPGGGDQAVSDNSDTSAGHRGAHLLHGLQYGHPMKLEAGEGSSWMAA

SEQ ID NO: 602 - protein, 61 aa, Glycine max
MQEGEQQLIITGTMLMHSTNLNLAPPCTTLMDKELIGASKNNKTTLMPLTLCLIQIFINFS

SEQ ID NO: 603 - protein, 292 aa, Glycine max
  misc_feature (276)..(277): Xaa can be any naturally occurring amino acid
LKYWGPSTHINFPLENYQNELEEMKNMTRQEYVAHLRRKSSGFSRGASMYRGVTSRHHQHGRWQARIGRVAGNKDLYLGTFSTQEEAAEAYDIAAIKFRGANAVTNFDITRYDVEKIMASSNLLSSELARRNRETDNETQCIDQNHNKPSAYEDTQEAILMHQKSCESENDQWKMVLYQSSQQLEQNPPTIESDRTNQSFAVALDSMFHQEVEESSKVRTHVSNPSSLATSLSSSREGSPDRTSLPMLSGMPSTASKLLATNPNNVNSWDPSPHLXXALTLPQMPVFAAWTD

SEQ ID NO: 604 - protein, 284 aa, Glycine max
  misc_feature (129)..(129): Xaa can be any naturally occurring amino acid
IGRVAGNKDLYLGTFSTQEEAAEAYDVAAIKFRGLSAVTNFDMSRYDVKSILESTTLPIGGAAKRLKDMEQVELSVDNGHRADQVDHSIIMSSHLTQGINNNYAGGGTATHHNWHNAHAFHQPQPCTTXHYPYGQRINWCKQEQQDNSDASHSLSYSDIHQLQLGNNGTHNFFHTNSGLHPMLSMDSASIDNSSSSNSVVYDGYGGGGGYNVIPMGTTTTVVANDGDQNPRSNHGFGDNEIKALGYESVYGSTTDPYHAHARNLYYLTQQQPSSVDAVKASAYD

SEQ ID NO: 605 - protein, 262 aa, Glycine max
  misc_feature (133)..(134): Xaa can be any naturally occurring amino acid
  misc_feature (163)..(164): Xaa can be any naturally occurring amino acid
  misc_feature (170)..(170): Xaa can be any naturally occurring amino acid
  misc_feature (174)..(174): Xaa can be any naturally occurring amino acid
MIKVFHELFSATLSFLIKVGNYWPTFVFFSLYHFRHHQHGRWQARIGRVAGNKDLYLGTFSTQEEAAEAYDIAAIKFRGTSAVTNFDISRYDVKRICSSSTLIAGDLAKRSPKESPALVPAEDFNSCGSSMPXXSQPPPLAITDGEHSDELSNMMWNANNSDXXAQNEVXVLNXNNNVTESSSSQQVSPSSNKDALNPQSPKCSVGLPNEFGVSGADYGHGYFTLDGPKYDDGNNENDHMSTNRLGNLGLVNQVPMFALWNE

SEQ ID NO: 606 - protein, 65 aa, Glycine max
GYDKEEKAAKAYDLAALKYWGPTTHINFPLSTYEKELEEMKHMTRQEFVANLRRKSSGFSRGASV

SEQ ID NO: 607 - protein, 218 aa, Glycine max
LKYWGPSTHINFPLENYQNELEEMKNMTRQEYVAHLRRKSSGFSRGASMYRGVTSRHHQHGRWQARIGRVAGNKDLYLGTFSTQEEAAEAYDIAAIKFRGANAVTNFDITRYDVEKIMASSNLLSSELARRNRETDNETQCIDQNHNKPSAYEDTQEAILMHQKSCESENDQWKMVLYQSSQQLEQNPPTIESDRTNQSFAVALDSMFHQEVEESSKV

SEQ ID NO: 608 - protein, 318 aa, Glycine max
DNSCKKEGQGRKGRQVYLGGYDMEEKAARAYDMAALKYWGPSSHINFPLENYQNELEEMKNMTRQEYVAHLRRKSSGFSRGASMYRGVTRHHQHGRWQARIGRVAGNKDLYLGTFSTQEEAAEAYDIAAIKFRGVNAVTNFDITRYDVEKIMESNNLLSSEQAKRKREMDDGTRSEATVNQKPSTYDHTQETILMQKRCKNQSEWKMVQFPCPQQLDQNQRIESCRTQPFSTDLDNMFRHQVEERSNMGTHLSNPSSLVTSLSSSREESPDKTSMPMLFGMPSTVSKLLANVDSWDLSSNLRTALSMPQMPIFAAWTD

SEQ ID NO: 609 - protein, 238 aa, Glycine max
  misc_feature (115)..(115): Xaa can be any naturally occurring amino acid
  misc_feature (192)..(192): Xaa can be any naturally occurring amino acid
MAAPFSAASLFAIREEDQNQMKQQHSSTPSSSTTPAAPPPQKKRRNQPGTPYPDAEVIALSPKTLMATNRFLCEVCNKGFQREQNLQLHRRGHNLPWKLKQKTNKEPKRKVYLCXEPTCVHHDPSRALGDLTGIKKHYSRKHGEKKWKCDKCSKKYAVQSDWKAHSKTCGTREYRCDCGTLFSRRDSFITHXAFCDALAHESARHPSSVNHLGTHHLYGTNHMSLGLGAQLQNHQISA

SEQ ID NO: 610 - protein, 320 aa, Glycine max
MAAPFSAASLFAIREEDQNQMKQQHSSTPSSSTTPAAPPPQKKRRNQPGTPYPDAEVIALSPKTLMATNRFICEVCNKGFQREQNLQLHRRGHNLPWKLKQKTNKEPKRKVYLCAEPTCVHHDPSRALGDLTGIKKHYSRKHGEKKWKCDKCSKKYAVQSDWKAHSKTCGTREYRCDCGTLFSRRDSFITHRAFCDALAHESARHPSSLNPLGTHHLYGTNHMSLGLSAQLQNHQAATNSILSLGSAPKFEHLISPNLHHSPSSFGVQSPPPPPQSSSFFMTDPNQAFQDLQSQNQGHLFSNKQLHGLMQLPDLQGTTNI

SEQ ID NO: 611 - protein, 271 aa, Glycine max
  misc_feature (203)..(203): Xaa can be any naturally occurring amino acid
MDKSEQTQQQQQQQQHVMGVAAGASQMAYSSHYPTAPMVASGTPAVAVPSPTQAPAAFSSSAHQLAYQQAQHFHHQQQQHQQQQLQMFWSNQMQEIEQTIDFKNHSLPLARIKKIMKADEDVRMISAEAPVIFAKACEMFILELTLRSWIHTEENKRRTLQKNDIAAAISRNDVFDFLVDIIPRDELKEEGLGITKATIPLVXSPADMPYYYVPPQHPVVGPPGMIMGKPVGAEQATLYSTQQPRPPMAFMPWPHTQPLQQQPPQHQQTDS

SEQ ID NO: 612 - protein, 254 aa, Glycine max
MGVATGASQMAYSSHYPTAPMVASGTPAVAVPSPTQAPAAFSSSAHQLAYQQAQHFHHQQQQHQQQQLQMFWSNQMQEIEQTIDFKNHSLPLARIKKIMKADEDVRMISAEAPVIFAKACEMFILELTLRSWIHTEENKRRTLQKNDIAAAISRNDVFDFLVDIIPRDELKEEGLGITKATIPLVNSPADMPYYYVPPQHPVVGPPGMIMGKPVGAEQATLYSTQQPRPPMAFMPWPHTQPQQQQPPQHQQTDS

SEQ ID NO: 613 - protein, 271 aa, Glycine max
MDKSEQTQQQQQQQQHVMGVAAGASQMAYSSHYPTASMVASGTPAVTAPSPTQAPAAFSSSAHQLAYQQAQHFHHQQQQHQQQQLQMFWSNQMQEIEQTIDFKNHSLPLARIKKIMKADEDVRMISAEAPVIFAKACEMFILELTLRSWIHTEENKRRTLQKNDIAAAISRNDVFDFLVDIIPRDELKEEGLGITKATIPLVGSPADMPYYYVPPQHPVVGPPGMIMGKPIGAEQATLYSTQQPRPPVAFMPWPHTQPLQQQPPQHQQTDS

SEQ ID NO: 614 - protein, 363 aa, Oryza sativa
  misc_feature (27)..(27): Xaa can be any naturally occurring amino acid
DGQGDMRLISGIIAVEEKGRVARVGKXSGGYDKEDKAARAYDLAALKYWGTTTTTNFPISNYEKELDEMKHMTRQEYIAYLRRNSSGFSRGASKYRGVTRHHQHGRWQARIGRVAGNKDLYLGTFSTEEEAAEAYDIAAIKFRGLNAVTNFDMSRYDVKSILESSTLPVGGAARRLKEAADHAEAAGATIWRAADMDGAGVISGLADVGMGAYAASYHHHHHHGWPTIAFQQPPPLAVHYPYGQAPAAPSRGWCKPEQDAAVAAAAHSLQDLQQLHLGSAAAHNFFQASSSSTVYNGGGGGYQGLGGNAFLMPASTVVADQGHSSTATNHGNTCSYGNEEQGKLIGYDAMAMASGAAGGGYQL

SEQ ID NO: 615 - protein, 105 aa, Oryza sativa
NYEKELDEMKHMNRQEFVASLRRKSSGFSRGASIYRGVTRHHQHGRWQARIGRVAGNKDLYLGTFGTQEEAAEAYDIAAIKFRGLNAVTNFDMSRYDVKSIIESS

SEQ ID NO: 616 - protein, 692 aa, Oryza sativa
MATMNNWLAFSLSPQDQLPPSQTNSTLISAAATTTTAGDSSTGDVCFNIPQDWSMRGSELSALVAEPKLEDFLGGISFSEQQHHHGGKGGVIPSSAAACYASSGSSVGYLYPPPSSSSLQFADSVMVATSSPVVAHDGVSGGGMVSAAAAAAASGNGGIGLSMIKNWLRSQPAPQPAQALSLSMNMAGTTTAQGGGAMALLAGAGERGRTTPASESLSTSAHGATTATMAGGRKEINEEGSGSAGAVVAVGSESGGSGAVVEAGAAAAAARKSVDTFGQRTSIYRGVTRHRWTGRYEAHLWDNSCRREGQTRKGRQGGYDKEEKAARAYDLAALKYWGPTTTTNFPVNNYEKELEEMKHMTRQEFVASLRRKSSGFSRGASIYRGVTRHHQHGRWQARIGRVAGNKDLYLGTFSTQEEAAEAYDIAAIKFRGLNAVTNFDMSRYDVKSILDSAALPVGTAAKRLKDAEAAAAYDVGRIASHLGGDGAYAAHYGHHHHSAAAAWPTIAFQAAAAPPPHAAGLYHPYAQPLRGWCKQEQDHAVIAAAHSLQDLHHLNLGAAAAAHDFFSQAMQQQHGLGSIDNASLEHSTGSNSVVYNGDNGGGGGGYIMAPMSAVSATATAVASSHDHGGDGGKQVQMGYDSYLVGADAYGGGGAGRMPSWAMTPASAPAATSSSDMTGVCHGAQLFSVWNDT

SEQ ID NO: 617 - protein, 135 aa, Helianthus annuus
PSPPAQLAQQQLAYQHIHQQQQQQLHQQLQNFWANQYQEIEQTTDFKNHSLPLARIKKIMKADEDVRMISAEAPVIFARACEMFILELTLRSWNHTEENKRRTLLKNDIAAAITRTDIFDFLVDIVPREDLKDEV

SEQ ID NO: 618 - protein, 97 aa, Populus trichocarpa
LTSKINHQQQVFSLLEKRNTCISHRETKTMTTSKRLSERKVAKFHKNITKRGSVPETSTKKGYDYPVGPILLGFFVFVVIGSSLFQIIRTASSGGMA

SEQ ID NO: 619 - protein, 269 aa, Populus trichocarpa
IQEAGGNETVAAKPETKAEGANPENKSEVEKKASGVKAVGENSLPSSKAPEVPPDNEFEKRIRPEVIPPNEINVTFSDIGALEETKESLQELVMLPLRRPDLFKGGLLKPCRGILLFGPPGTGKTMLAKAIAKEAGASFINVSMSTITSKWFGEDEKNVRALFTLAAKVSPTIIFVDEVDSMLGQRSRAGEHEAMRKIKNEFMTHWDGLLTNQVERILVLAATNRPFDLDEAIIRRFERRIMVGLPSAEHRERILNTLLGKRKDGRTRF

SEQ ID NO: 620 - protein, 176 aa, Populus trichocarpa
TGDYVFQNCSLQLPSEATSNERTSNNGGGDNKNSSIGLSMIKTWLRNQPAPTQQDTNNKNNGGAQSLSLSMSTGSQSAASALPLLAVNGGVNNTGGDQSSSDNNKQQKSTTPSLDSQTGAVESVPRKSIDTFGQRTSIYRGVTRHRWTGRYEAHLWDNSCRREGQTRKGRQGMGWL

SEQ ID NO: 621 - protein, 185 aa, Populus trichocarpa
KKKAYVCPEPTCVHHHPSRALGDLTGIKKHYCRKHGEKKWKCEKCSKIYAVQSDWKAHSKTCGTREYRCDCGTLFSRKDSFITHRAFCDALAEESARLSAHQLIISQNPNAHALLLQNPLQTHHPHSLFSTTAHHQISFTSPWDPPHHQNPCSNNPLNPVHIKPETTGHFQIPASLLQEPPLTMP

SEQ ID NO: 622 - protein, 329 aa, Populus trichocarpa
MQDTHSIGGGGRLFSGGGGGDRKLRPHHHQNQQALKCPRCDSLNTKFCYYNNYNLSQPRHFCKSCRRYWTKGGVLRNVPVGGGCRKTKRSRPKQNTPITTCDTITASSTTPQELQEQHQQRDHKSSDSHSSSESSSLTATNNTNANTTAEAVSALSVSSVVSNNLLNGIVESKIFPHGNVNPSFEPSLLEQGSDCGIFSEIGSFTSLITSTNDLFGFSNMMSQHQPPHQQQGLEHHVQHNQNQQQWQNHQQQEMTGGGGLIDQTVHVELSALPSSRSTKNDDGEFGALDWQLGSGDQATSLFDLPNAVDQAYWSQSQWNDQDHPSLYIP

SEQ ID NO: 623 - protein, 68 aa, Brassica oleracea
MTTSKRLAGRKIEKFDKNITKRGFVPETTTKKGKDYPVGPILLGFFVFVVIGSSLFQIIRTATSGGMA

SEQ ID NO: 624 - protein, 86 aa, Brassica oleracea
EKMLGKGLKALQVPRSDYIVATKCGRYEEGFDFSAERVTKSIDESLERLQLDYVDILHCHDIEFGSLDQIVSETIPALQKLKREGK

SEQ ID NO: 625 - protein, 132 aa, Brassica oleracea
ELKIMVRPPCCDKGGVKKGPWTPEEDIILVTYIQEHGPGNWRAVPTNTGLLRCSKSCRLRWTNYLRPGIKRGNFTEHEEKMIVHLQALLGNRWAAIASYLPQRTDNDIRNYWNTHLKKKLNKANQDSHQDFD

SEQ ID NO: 626 - protein, 129 aa, Brassica oleracea
KEKMSPSFLFFTLFLIKEMSSSSSANSFEDGKYKTDLLTVGLSSCCWKKPSSSPTPQSPPKRLLVATPVEEGEYPVVMLLHGYLLYNSFYSQLMLHVSSHGFIVIAPQLYSIAGPDTMDEIKSTAEIID

SEQ ID NO: 627 - protein, 321 aa, Brassica oleracea
MSSSSSRNAFVDGKYKPDLLTVDLASRCRCYKTTPSSSLTPPPPPKSLLVATPVEEGEYPVVMLLHGYLLYNSFYSQLMLHVSSYGFIVIAPQLYNIAGPDTIDEIKSTAEIIDWLSVGLNHFLPPQVTPNLSKFALTGHSRGGKTAFAVALKKFGYSSELKISAIIGVDPVDGTGKGKQTPPPVLTYEPNSFNLEKMPVLVIGSGLGELARNPLFPPCAPTGVNHREFFQECQGPAWHFVAKDYGHLDMLDDDTKGLRGKSSYCLCKNGEERKPMRRFIGGIVVSFLMAYLEDDDCELVKIKAGCHEGVPVEIQEFEVKK

SEQ ID NO: 628 - protein, 68 aa, Vitis vinifera
MTTSRRLADRKVEKFEKNITKRGSVPETTTKKGSDYPVGPVLLGFFVFVVIGSSLFQIIRTATSGGVA

SEQ ID NO: 629 - protein, 177 aa, Vitis vinifera
FTEIMRESITTFIKESVDEELKDNSDSDAKPTQKKRLTFCVEGNISVGKTTFLQRIANETLELRDLVEIVPEPINKWQDVGPDHFNILDAFYAEPQRYAYTFQNYVFVTRVMQERESSGGVKPLRLMERSVFSDRMVFVRAVHEANWMNEMEISIYDSWFDPVVSCLPGLIPDGFIY

SEQ ID NO: 630 - protein, 115 aa, Vitis vinifera
EENKRRTLQKNDIAAAISRTDVFDFLVDIIPRDELKEEGLGVTKASIPVVGSPADAIPYYYVPPPPVGPTGMIMGKAVVDQSSIYAAQQPRPPVPFMPWPQAQSQPQQPQQQQTD

SEQ ID NO: 631 - protein, 172 aa, Vitis vinifera
MDQPGHGQPPAMGMVGSAAQMPYGIPPFQPNQMVGTSGPGTVGSIQSPTQPAGISSPAQLAQHQLAYQHIHQQQQQQLQQQLQNFWQNQYQEIEQTTDFKNHSLPLARIKKIMKADEDVRMISAEAPVIFARACEMFILELTLRSWNHTEENKRRTLQKNDIAAAITRTDII

SEQ ID NO: 632 - protein, 441 aa, Triticum aestivum
  misc_feature (11)..(11): Xaa can be any naturally occurring amino acid
  misc_feature (23)..(23): Xaa can be any naturally occurring amino acid
  misc_feature (35)..(35): Xaa can be any naturally occurring amino acid
  misc_feature (46)..(46): Xaa can be any naturally occurring amino acid
EAPFFFPKVCXIGLTIFQEIGLXGKDTLKLEANEXVLKGALESKKXGSDKSPGKDGDAPPPKPEIPDNEFEKRIRPEVIPPSELGVTFDDIGALDDIKESLQELVMLPLRRPDLFKGGGLLKPCRGILLFGPPGTGKTMLAKAIANDAGASFINVSMSTITSKWFGEDEKNVRALFSLAAKVAPTIIFVDEVDSMLGQRARCGEHEAMRKIKNEFMSHWDGILSKSGERILVLAATNRPFDLDEAIIRRFERRIMVAFPTQDSRELILRTVLSKEKVDKDIEYKELATMTEGYSGSDLKNLCVTAAYRPVRELLKKERLKEMERRKTEAEQKTAAAAEDSDKPENKKVSSDNKENNPEKVDSSDSKEGSSESKDDSSETKAEGDKEAVVDLRPLTMEDLRQAKNQVAASFAAEGAVMNELKQWNDLYGEGGSRKKEQLTYF

SEQ ID NO: 633 - protein, 313 aa, Triticum aestivum
MGRPPCCDKEGVKKGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQAGGDAAAKPAAQRPASSSKGQWERRLQTDINMARRALREALTTLDDIKPQQPDAADGVNGPAAAGADSGSPAASSSSAASLSQCSPSAAGPYVLTTANISRMLDGWASKGRSAGAAADSPSGSSASEVSYGSGAAARALGSAFEYDRKPAVLAPDQTQLNAIETWLFADDNSNNDHHGHAAGGSGLLGVPAMGYPF

SEQ ID NO: 634 - protein, 81 aa, Triticum aestivum
CDKLGVKKGPWTPEEDIILVSYIQEHGPGNWRSVPVSTGLMRCSKSCRLRWTNYLRPGIKRGNFTSHEEGVIVHLQSLLGN

SEQ ID NO: 635 - protein, 313 aa, Triticum aestivum
MGRPPCCDKEGVKKGPWTPEEDLVLVSYVQEHGPGNWRAVPTRTGLMRCSKSCRLRWTNYLRPGIKRGNFTDQEEKLIVHLQALLGNRWAAIASYLPERTDNDIKNYWNTHLKRKLQAGGDAAAKPAAQRPASSSKGQWERRLQTDINMARRALREALTTLDDIKPQQPDAADGVNGPAAAGADSGSPAASSSSAASLSQCSPSAAGPYVLTTANISRMLDGWASKGRSAGAAADSPSGSSASEVSYGSGAAARALGSAFEYDRKPAVLAPDQTQLNAIETWLFADDNSNNDHHGHGGGGSGLLGVAAMGYPF

SEQ ID NO: 636 - protein, 146 aa, Triticum aestivum
  misc_feature (88)..(88): Xaa can be any naturally occurring amino acid
  misc_feature (116)..(116): Xaa can be any naturally occurring amino acid
  misc_feature (120)..(120): Xaa can be any naturally occurring amino acid
YDKEEKAARAYDLAALKYWGATTTTNFPVNNYEKELEEMKHMTRQEFVASLRRKSSGFSRGASIYRGVTRHHQHGRWQARIGRVAGNXDLYLGTFSTQEEAAEAYDIAAIKFRGLXAVTXFDMTRYDVKSILDSTALPIGSAAKRL

SEQ ID NO: 637 - protein, 313 aa, Triticum aestivum
  misc_feature (225)..(225): Xaa can be any naturally occurring amino acid
  misc_feature (269)..(269): Xaa can be any naturally occurring amino acid
  misc_feature (291)..(291): Xaa can be any naturally occurring amino acid
VYLGGYDKEDKAARAYDLAALKYWGTTTTTNFPINTYEKEVDEMKHMTRQEYIAYLRRNSSGFSRGASKYRGVTRHHQHGRWQARIGRVAGNKDLYLGTFSTEEEAAEAYDIAAIKFRGLNAVTNFDMSRYDVKTILESSTLPVGGAARRPKEVADHPEAGATIWRAGMDGGVISQLTDVGMGTYASYHHGWPTIAFQQPSPLSVHYPYVAQPSRGWCKPEQDAXVATQSLQDLQQLHLGTAAHNYFQASSSSTVYNGGGVGGYQQGTXGNAFLMPASTVVDEQGHSSTAXNQGSTCSYGDEEGKLNLGYDAM

SEQ ID NO: 638 - protein, 242 aa, Triticum aestivum
KAEIFTRHHQHGRWQARIGRVAGNKDLYLGTFSTEEEAAEAYDIAAIKFRGLNAVTNFDMSRYDVKTILESSTLPVGGAARRPKEVADHPEAGATIWRAGMDGGVISQLTDVGMGTYASYHHGWPTIAFQQPSPLSVHYPYVAQPSRGWCKPEQDASVATQSLQDLQQLHLGTAAHNYFQASSSSTVYNGGGYQQGTSGNAFLMPASTVVDEQGHSSTATNQGSTCSYGDEEGKLNLGYDAM

SEQ ID NO: 639 - protein, 197 aa, Triticum aestivum
MEPSSQPEPVVGVATAGSQAYPPPAAYPAPAMPAAIPPGSQPAVPFPANPAQLSAQHQLVYQQAQQFHQQLQQQQQQQLREFWATQMEEIEQATDFKNHTLPLARIKKIMKADEDVRMISAEAPVVFAKACEVFILELTLRSWMHTEENKRRTLQKNDIAAAITRTDIYDFLVDIIPRDDMKEEGLGLPRVGLHLLL

SEQ ID NO: 640 - protein, 88 aa, Triticum aestivum
IEPYLPLMEALVAAWLPGTEGQGIADVLFGDYGFTGKLSRTWFKSVDQLPMNFGDPHYDPLFPLGFGLAINSSQPGFSGTRSRGDKKE

SEQ ID NO: 641 - protein, 54 aa, Triticum aestivum
FEGQGVADVLFGDYGFTGKLSRTWFKSVDQLPMNVGDKHYDPLFPFGFGLTTKG

SEQ ID NO: 642 - protein, 70 aa, Triticum aestivum
TEGQGVADVLFGDYGFTGKLSRTWFKSVDQLPMNFGDPHYDPLFPFGFGLAVNSSQPGFSGARSRGDKKE

SEQ ID NO: 643 - protein, 88 aa, Linum usitatissimum
ALGDLTGIKKHFSRKHGEKRWKCEKCSKKYAVQSDWKAHSKSCGTKEYKCDCGTVFSRRDSFITHRAFCDALAEETKASAGIIVNHST

SEQ ID NO: 644 - protein, 68 aa, Solanum lycopersicum
MTTSRRLADRKVERFEKNITKRGAVPETTAKKGSQYPVGPILLGFFVFVVIGSSLFQIIRTATSGGMA

SEQ ID NO: 645 - protein, 134 aa, Solanum lycopersicum
  misc_feature (15)..(15): Xaa can be any naturally occurring amino acid
EIGVTFADIGALDEXKESLQELVMLPLRRPDLFNGGLLKPCRGILLFGPPGTGKTMLAKAIANEAGASFINVSMSTITSKWFGEDEKNVRALFTLAAKVSPTIVFVDEVDSMLGQRTRVGEHEAMRKIKNEFMT

SEQ ID NO: 646 - protein, 70 aa, Solanum lycopersicum
  misc_feature (28)..(28): Xaa can be any naturally occurring amino acid
IKNYWNTHLKKKLKKFQIELDSHNLTLXPPNLDNSNTNNYDHHHHQFTKLLNSPNSSSSSSLYASSTENI

SEQ ID NO: 647 - protein, 68 aa, Gossypium hirsutum
MTTSRRIADRKVLKFEKNITKRGAVPETSTKKGKDYPVGPMLLGFFVFVVIGSSLFQIIRTATSGGMA

SEQ ID NO: 648 - protein, 68 aa, Gossypium hirsutum
MTTSRRLAERKVEKFQKNITKRGAVPETTTKKGKDYPVGPVLLGFFIFVVIGSSLFQIIRTATSGGMA

SEQ ID NO: 649 - protein, 264 aa, Gossypium hirsutum
MLAKAIANEAGASFINVSMSTITSKWFGEDEKNVRALFTLAAKVAPTIIFVDEVDSMLGQRTRVGEHEAMRKIKNEFMTHWDGLMTKAGERILVLAATNRPFDLDEAIIRRFERRIMVGLPSIESREMILRTLLSKEKAENLDYKELATMTEGYSGSDLKNLCVTAAYRPVRELIQQERLKDQEKKRQEEAGKSTEDVTESKEEHKEERVVTLRPLNMEDMRQAKNQVAASFASEGSVMAELKQWNELYGEGGSRKKQQLTYFL

SEQ ID NO: 650 - DNA, 703 bp, Brassica rapa; identical to SEQ ID NO: 450

SEQ ID NO: 651 - DNA, 1631 bp, Brassica napus
ggatctataaatagtttaattatggcaatcaaaggtttcgagaaagaataagaggcttatcgcatgtttgcttcacgcaaacaacaaaatatgagagataaagaagagagagacagagatcgttctttttttttggttagctttgtcgtcgcgtggctttaaaggctttcttctctatactctcttctttaccaaaccctaatctcctttcttcacctcctcttctcaaaacttcctatcttctatcttcaagaaattttctcaataattcaaaaaccctaaaagcaagaaagagagaacaactcgttaatcgtagggttgtcatgagcggcggtgggaacacaatcacctccgtgggaggtggtggttgtggtggaggaagtagcagcggtggaggaggaagtagtggcggtggtggtgggccatgtggtgcttgtaagtttttaaggagaaagtgtgttccgggttgcatattcgcaccatacttcgactcggagcaaggctcggcttattttgcggcggtgcataaagtttttggggcaagcaacgtctcaaagcttctcttacacataccggttcatcgacgggctgatgcagttgtaaccatttgctatgaagctcaggctcggataagggatcctatctatggttgcgttgctaacatatttgctcttcagcaacaggtggtgaatctacaggcagaagtttcttacttacaagcccatttggcatccctagagctacctcagccgcaaacgcgaccaccgcctctaacgcaaccacaaccgctcttcttcactccgcctcgcctctttccataacagatttgcctgcatcagtctcaccatacgatttagcctctatagtcgatccaccgacgtcgtgggctacacaacaacgaagattcgttgatccacgtaaccaatacggtgggtcatcatcatcttcttcagctgccgtggggctcggtggtggaaacagtgatcttcaagcattagcacatgagctcctacatagacaaggatctcctccacctgcagctaccgacggctcgccgtctcggtccatgtctagatgagtttggctttgatcaatatatctgctctttgttattaggaaaattaaattactactcaataaatttaattttctcggaatattataaggacctattgattataattttctgacatttacctataaaactgtatttccttttttctccagtgagtaattcttatgttcccttrattmtaatwtatactcatgcatktaatatgctgccgtgtataccatcttcatgttcccatcttcatatttccgcctcgggaatttttttcacaaggccctttcgccaccgtgggccttatccttccattcttatatgttttatttttccagtagggagataaacttatgttaaaataaccaggttcatttcacatttttcgattcagattaaaccaaaatgtaaatacacataacgtaagtccgatttcgagatgtaataatatcccacatcgtgtgggatatatgttcttaggacattgcatgggcaatcttccacttttaaactagcttttgggtatcagcatataattttttatataaacagtttcttactttgtgac

SEQ ID NO: 652 - DNA, 713 bp, Raphanus sativus
ggaccaaaccctaatctcctctcctcatctcatcttctcaaaaattcttatcttctccaaaaaaacataaaattttctcaataactcgaaaaccctaaacgcaagagaaagaaaataactcgttaagcgtagggttgttatgagcggcggtggaaacacaatcaccgccgtgggaagtggcggcggtggaggaggaagcagtagcggtggtggtggtgggccatgcggtgcttgtaagtttttaaggagaaagtgtgttccaggttgcatattcgcaccatacttcgactctgagcaaggctcggcttattttgcggcggtgcataaagttttcggagccagcgacgtttcaaagcttctcttacacataccggttcatcgacggtccgatgcagttgtgaccatttgctatgaagctcaggctcggataagggatcctatctatggttgcgttgctcacatatttgctcttcagcaacaggtggtgaatctacaggcagaagtttcttacttacaagcccatttggcatccctagagctaccacagccgcaaacgcgaccaccgcctctaacgcaaccacaaccgctctttttcactcagcctccccctctttccttaacagatttgcctgcatcagcctcaccattaccctcaacatacgatttagcttctatcttcgatcaatcgacaccgtcatgggctacacaacaac

SEQ ID NO: 653 - DNA, 597 bp, Brassica oleracea
ggttctctctctcacttccagatcctgacacactttctctgtctctctccagacataatctccaatcaaatggtgaaactcgcgacggcgcgtgagattagaacgtacggccctcggctcgggaggagcagagccgagtacatcaacgctggtctatacctgttcgcaaccgtggtgctcatcggcggattcacagccaccggtttctcgtgggagccaagatccggcctcgtccttattctcttggctcttgctcttataactgccgtgaatgttcacgatctggtagctcatttagccggaattgattaccgtttaaagttaatggagtatgatttgcaactggggctagtggaatttgccgtccctctggttcagatagctggttcggtcgtcttcttcttgggcatccttttcgtattcaatcaggcagagacaaaacatggaaatagtggaagagagaagcacgcattaaacatgcttattgcggggcctttgctttgggtgataggatcgattcacaactcgtgccaaatctatgaaagagttgacagtcacgtccagatactacagcagtgtgtgcacattccctttctt

SEQ ID NO: 654 - DNA, 567 bp, Brassica rapa
gaaggaaactcacaaacacacttcatgcctttgaatgkcgcttataaagatattataaagggataatgagaatcagctgtaatgggtgtagagtcctacgcaagggttgcaaccaagattgcaccataagaccatgtcttcaatggatcaaatccgcagactcccaagccaatgccacactcttccttgccaagttctatggtcgagccggtctccttaacctcatcgaatctggtcctgaccatcttcgtcccgcaatatttaggtcacttttgtacgaagcgtgtggacggatcgtgaacccygtggatggttctgtgggtctgatgtggtctggaaactgggcccagtgccaagcagccgttgatgccattctcaacggcttacccatcactcacacgcctctccccagtgcatcctcgtcgcaccagatcattcctcctcacaggacatacgacatacgccacgtggcgaaagatccaacaacaggaggcgacagttcgragagtctggcccttgccccacgtgttaacggtaacaaggcgaagacacaaactggccggttaa

SEQ ID NO: 655 - DNA, 983 bp, Brassica napus
gtccacttccaaggaaactcacaaacacacttcatgcctttgaatgtcgcttataaagatattataaagggataatgagaatcagctgtaatgggtgtagagtcctacgcaagggttgcaaccaagattgcaccataagaccatgtcttcaatggatcaaatccgcagactcccaagccaatgccacactcttccttgccaagttctatggtcgagccggtctccttaacctcatcgaatctggtcctgaccatcttcgtcccgcaatatttaggtcacttttgtacgaagcgtgtggacggatcgtgaaccctgtggatggttctgtgggtctgatgtggtctggaaactgggcccagtgccaagcagccgttgatgccattctcaacggcttacccatcactcacacgcctctccccagtgcatcctcgtcgcaccagatcattcctcctcacaggacatacgacatacgccacgtggcgaaagatccaacaacaggaggcgacagttcggagagtctggcccttgccccacgtgttaacggtaacaaggcgaagacacaaactggccggttaaaacgcctagcagagaccgtggactwccaactaggtgaatgtagtcacgacacgtggcagctccagtgttctggtgcaacgcatggctatggtcagttggcgttggagaacgtggcgaatcgaagggaagctccattaaaccaaagctcgaatcttgggcgtgatgatcaagtcgataccaacgaggttggcttagagctcagacttggttagaagctaaaaggacaaaaaaaaaagagagcataattgttatcgtaactgccgttttcattaataatttcactttctacttgcaaggggaaaaggtcaagagacgcaaatgaaacttgagctactggcttgtatgtattttaatttgatattaatgtaaactcaatatgtgatagaggtcctgagtttcgacgtgcc

SEQ ID NO: 656 - DNA, 1810 bp, Brassica napus
ttatactcttacacgcaaagaagaagatctaagatggcrtcatcatcatataacgcaagcgttgttccttcatcatcatcctctgctcagccgttcttcctcactggctccggcgtcggagagaacgactttrgccagaaagatacttttgtgtcaatgattcaacarcctaactcctcagctccaccacccaagaaacgaagaaaccaacccggaaacccaaatcctgatgcggaagtggtagctttatctccaaagacaataatggctacaaacaggttcatatgcgatgtatgcaagaaagggtttcaaagagaacaaaacctacagcttcaccgaagaggacacaatctcccatggaaactcaaacagaagtcaaccaaagaagtaaagaggaaagtctatctttgtccggaacccacgtgcgtccaccatgacccctcacgtgctctcggagacctcaccggaattaagaagcactattaccgtaaacatggagaaaagaagtggaagtgcgataaatgttctaagcgttacgctgttcaatcggattggaaagctcactctaagacctgtggtactaaagagtatcgatgtgactgtggtaccatcttctctagacgcgatagttacattacacacagggctttctgtgatgcattgatacaagagactgctagaaaccctaccttgagcttcacgtcaatggaagctgctagcagcggcgccggctccggtggattgtacgggagactggatggtggcaggactctatcccaccaccatttgagtggccatccaaactctggattttcgcctctcgcgggttacaatctaaacattgcatcttctgaaaatagcagacactttgttccgcagacgtcaaaccctaacttcttaatccaatcgagccaaggaatgctgactgtaccgaacaacaacgatcagagtttcatgaaccatcatggtctaaaccagtttgatccagtcaacaacataaactccaaaagtagcacgaacaacagctttttcaacctcggattctttcaagaaaacatcaagaactcagagacgagtcttccttctctatatagctccgacgttcttgttaatcaccctgaagaaagcttgaacgtgggttctaacgtgtcagccacggcactgcttcagaaagctactcaaatgggttccatcacaagcaacgatccttctgctttaytcagaggcttagcttcttcgtcaagtaatgattttggagragggcagattatggggaacgataataacggtaatcttcaaggtctaatgaactcactagtsgcagtaaatggcggtggtgccggcggatccggtggcaatatattcgatgttcatttcggaaacaatggaaatatgagcggctcggacaagttaacgttagattttcttggagttggaggaatggttagaaatgtaaatcgcggccgtggtcgtggcgacgtttctttggatggtgaactgaagttttcggagcaaaatcatccatttggaagatcttgaaaatatcttattattgtaacctactcacctataactagttaggtgataattttgctatcttcctttgttgctttcatagtctacatataatagatcttcactgaactctattaagtttgagactctcatcattagagtctgtcttttgttaagttgttatatagaagtttgctacttaatttwwgwtataactgaatgtataammtwttatggtttgaatataaacgattagcttaattttatgccaatttattgcttctgcaactttcag

SEQ ID NO: 657 - DNA, 1118 bp, Brassica napus
aacacattcattatcaaagaggcaagagcaaaaatatgtttaaactcagtctcgttctcgtatttcttattgcattttcaggaatagatgcaagtccgatcaaataccataatcctagctgctcagggaatatgtcagcgacagatgtagacctagttcatttcgcaatgaacttggagttcaccgaagccgaattcttcttgaaagcatctacaggaaaaggactcgatgcgtttaatgcaacacttgctaaaggcggaccaccccccattggagccaagaaggccaatcttgatcctataactaatcgaatcatcgaggagtttggttatcaggaaattggccatcttagggcgattgcggatatgacgggagggattccgcgtccgctgttgaatctaacgagagagaactttgccatgtttatggacagagcggttggacgtagatcaaacccgcggttcgatccttatgcgaattcactcaactatcttttagcatcatactacatcccttatgttggcctcactggttatgtcggagccatcccttaccttgtctacttcaacatcaaacggcttgtggcgggtcttttgggggtggaatcgggtcaagacggagtaataaggacgctcctttacgagagacagaacgagaaggtggaggaatacggaggagtcacggtggctgagctaaccaacgagatatctaacctccgtaatgaactcggtatgtgcgggatcaaagacgaaggcttgtgcgtgccactgtggctaggtgcggaaaatcgcaccactagcaacatcctctccgccgatccatactctctctcttatgaccgaacaccacaagaaatcctcagggtcatgtacggcaccggcaatgagcgccggcccggtgggttttggccgtgtggtgccaacgggaggatcgccaggatgtttcttgatgagaggtatcatggtaattagtattacgatgcatgttcagatggcaaaaattaaaaacttctattgatatactactagaaaataaaaataattgttaagattgtattatcattcttaacaatattataattctgtgtttaacaaaataaagaaacacctggttcttat

SEQ ID NO: 658 - DNA, 681 bp, Brassica napus
aaagaagtttcttccagcgaatttcacggttgttcttttccattacgatggaaatatggataaatggtgggatcttgagtggagttcaaaggccatacatatagttgcacagaaccagacgaaatggtggtttgcaaaacgatttctccatccggacgttgtatccatttatgattatgtttttctttgggatgaggatcttggagttgagaacttcacaccagagaggtacttgaagatagttaaggtagaaggactggagatatctcaaccggctttggaccgaaactcgactgaaatccaccacaagatcacactccgttccaaaacaaagaaatttcataggagagtttacataaatagaggcactaagaaatgttctaatactagtgaagatcctccttgcacaggatttgttgaaggaatggctcctgtgttttcaagagctgcttggttttgcacttggaaccttatacagaatgatttggttcatggatggggaatggatatgaagcttgggtattgtgcacagggagacaggaagatgaaggtagggatcgtggatagagagtacatctttcatcaaggcattcaaactttaggggaaagtgtacaatctgataagaagaccagagctcgtgatgttaggactaacagacatggccatacaacatttgattc

SEQ ID NO: 659 - DNA, 568 bp, Brassica oleracea
atccgggtggaaagtgaagccctttctggctctcatatgtacagcacttttgatcttttggtataggaccactaatattcaattcgaagagacagagctagaggaagcagattatccctttgacatggcaatggaatctgaaccagtcgatgcgaaactaaaaggcttgccgcgtggtatcttacagcctagatcggaccttgaactaaagcctctctggtctagtaatagtttaagggcaaagggtgttgaaatgactaaccgtaacttgttggccgtaccagtaggcattaagcaaaagggtaatgtcgacgccatggtaaagaagtttcttccagcgaatttcacggttgttcttttccattacgatggaaatatggataaatggtgggatcttgagtggagttcaaaggccatacatatagttgcacagaaccagacgaaatggtggtttgcaaaacgatttctccatccggacgttgtatccatttatgattatgtttttctttgggatgaggatcttggagttgagaacttcacaccagagaggtacttgaagatagttaag

SEQ ID NO: 660 - DNA, 1369 bp, Brassica napus
ggagatttggggaaactaataaatgttgtaaagaacccatctctcattctcgaattattgtttttgattagtgatagagagagaaacatatatatagagaaatataaatactcctaagaaattagaagagaaatatggttaaatcgagagatatgttgccgtccttggcgatggtgttagtgcaaattggctacgcaggcatgaacattacgtcgaagatggctatggaggccggcatgaagcctctcatccttgtcgcttatcgccaaatatttgcctctatcgccactttaccggttgcatttttccttgaacgtaagacaatacccaaaatcacaataagggttcttgtccaagccttcttctgctctatcactggtgtgacaggaaatcaagtgctctacttcataggacttcagaattcatctccgaccatcgcttgcgccttaactaatctcttaccggcggtcactttcctcctcgctgcaatcttcagacaagaagctgtagggattagaaaggtatcaggacaagccaaagtgatagggacagtagtatgtgtcgccggagcaatgcttctctccttctaccatggccacaccattggcattggagagtccaagatccattggacctatgctcaaaacatcacgacccatggttccgattctgccggttctaacttcttcttaggacctttcctaatcatggctgctgccgtttcttgtgccggttggttcattattcagacgaaaatgagtgaaacatttgcagcaccatacacgagcacacttctaatgtgtttgatgggaagtatccaatgtggagttgtcgctttaatctccgatcacaaactagctgattggtctctcagctctcctctccgcctcatytccgccctttacgccggagtggtggcgtctgcgttagcgttctgcttaatgtcatgggcgataaatataaaaggtcctctctacgtctctgttttcagccctttagtgcttgtaatcgtcgccgttttcagctggactcttcttgaagagaaactctacaccggcacgtttatgggatcagcacttgtggttattgggctatatggtgttttgtggggcaaagatagagagatgaatgagaaggaagacgaagtagagatccaaaagatggcgaaacaacaaccaacagtcaaaagggatataaatgaagatattgagtcgagattatcgtcttaaaacgttgatgcttcttcattatacaaagtggatatcccttttcaaagtgtttaatgtgtataccattttgaggccgatgatggagtgttaaattgtgtgtaattcgtgttcatattacttatgatgtctatattttaatt

SEQ ID NO: 661 - DNA, 734 bp, Brassica rapa
aagttctagagctttctccgccgatttcatctcctttagccatggagttacccccaaaagtgaagaacattctgcttcttgattctgaaggaaagcgcatagccgctaagtactactctggcgactggccaacaaatacggaaaaagaagcattcgaaaaagctgtcttctcaaagactcaaaaaacaaacgctcgcaccgaagttgaagtgacggcactggagaacaacatcattgtgtacaaatttgtgcaagatcttcatttctttgttacgggaggtgaagaagaaaacgagcttgtcttagccagtgtgcttcagggtctcttcgatgcagtgaatctcctcctcagaggcaatgttgataagagagaggcattggacaatcttgatctcatctttctatgctttgacgaaatcatcgatggcggtattgtcctggagacggatgcaaatgtgatagcagaaaaggcaggaatcaatagcattgaccctaacgctcctctatccgagcagacgataagtcaggcactggcgacggcaagagagcatttgacaaggtcacttatgaaatgatgtgcgtgtattgctttctagctaatgttggttggttggttgttatctaagtatgaactgaatgaagactacgactgagtgttagtttgtttgtctctgttgggtgactcttactcttagtcacagttaacgagttagataataaaaatcaaagtttat

SEQ ID NO: 662 - DNA, 802 bp, Brassica napus
gaacgtatcaaagaatttcctcttcgatatttttacttagagagagagagagagatcttctctttcaagttctagagctttctccgccgatttcatctcctttagccatggagttacccccaaaagtgaagaacattctgcttcttgattctgaaggaaagcgcatagccgctaagtactactctggcgactggccaacaaatacggctaaagaagcattcgaaaaagctgtcttctcaaagactcaraaaacaaacgctcgcaccgaagttgaagtgacggcactggagaacaacatcattgtgtacaaatttgtgcaagatcttcatttctttgttacgggaggtgaagaagaaaacgagcttatcttagccagtgtgcttcagggtctcttcgatgcagtgaatctcctcctcagaggcaatgctgataagagagaggcattggacaatcttgatctcatctttctatgctttgacgaaatcatcgatggcggtattgtcctggagacggatgcaaatgtgatagcagaaaaggcaggaatcaatagcattgaccctaacgctcctctatccgagcagacgataagtcaggcactggcgacggcaagagagcatttgacaaggtcacttatgaaatgatgtgcgtgtattgcttatttgctttctagctaatgttggttggttggttgttatctaagtatgaactgaatgaagactataactgtgtgtcagtttgtttgtctctgttggttgactcttagtcacaattacgagtwagataayaaaaatcaaagtttgta

SEQ ID NO: 663 - DNA, 1112 bp, Brassica napus
cctttcaagaggcggggattcaaaggttgcgataagcgatgtgttgttcaagaacgtaagaggaacaacaattactaaagatgaagtccagatcatgtgcagcaaatcagtactcggaagctaccggagatcaagtgctacgtggtgtcaactacgcttccgcagcagcggggattcttcctgacaccggaggaaactttgtggggcgaataccgttcgaccagcagattcataactttgagacaacgttaaatcaggtggctagtaagtccggtggtgcagtgacaattgcagactcggtggctcgaagcttgttcttcattggaatgggaagcaacgactatctcaacaattacttgatgcccaacttccctacccgtaaccaatacaacgctcaacaattcggtgacctcttggttcagcaatataccaatcaactcaccagattgtataatctaggtggtaggaaatttatagtgtccggacttggaagaatggggtgcattcctagtattctagctcaaggaaccgacggtaaatgctcggaagaagttaaccaacttgttcttcctttcaacacaaacgtcaagacaatgatcactaatctcaaccagaatcttcctgatgctaaattcatttacctcgataccgctaatatggtccaagacatcaccactaacccagccgtctatgggtttactactttggacaagggatgttgtgggataggacggaacagagggcagatcacttgtcttccctttgaaactccttgtcctaacagagagcagtacctgttttgggatgcttttcatcccacggagaaagttaatctcataatggccaagaaagcgtttgctggtgaccgcactgtcgcgtttcctatcaacattcaggaactggctagtctcaattagagaccatcttttttattcaagaaaaagtaaaagaacttcgtgttctgtctttgtagtttgtccttgtaacgtttttgagtttctttcgtattaaaaaacttagttaaatcgttttgcctctttcagtgcattgtgaaacatatatgagaacattagcactgattcctgttacgtttttaaggttggtgaatacac

SEQ ID NO: 664 - DNA, 1801 bp, Brassica napus
cggcacgagggttcatttcaaccagctctttctcgagaaaggaagttacaataacgtccatcaagctgctgctaaccaccgtcgatccgcctcttctggtgcctcttctcctcctcatgacaaccacaaacctgaagatgaggccgtggctcccgagggagaagaaggagaaggaaaagaagaagaagaagaagaagcccctgaagctgcaggagaagagcctaaggctgagtaactataccagttctcaagtttgaagttttatatgctttttatgtttacaaattaatatatgtatacaatcattctttttgtaaattattgtaaagcttggagagaatctgttgtaaaaacaaacctttaacatccaaaaaaaaaaaaaaaaaaaaaaaaaaaaaaaaaaaaactcgagactacaaacttaactttcaagctcaaacaactttacactatggctttccacttccggcgactttgcatgtcctctgctcttctggtggtagttctccaaatcctgcatggcgtatccggccaacttgttgtggttgaggaccctgtttctgcttctccgccaccattggtcgaacaagacggcagtgatggcattgtgcccgcactgtttgtgtttggtgactctctcatagacaatgggaacaacaataacatcccttcctttgctaaagctaattactttccttatggcatcgatttcaatggaggtcctaccggtaggttctgcaatggcttgaccatggtcgatggtattgcccaactattggggttgccgttgattccggcgtactcggaagctaccggagatcaagtgctacgtggtgtcaactacgcttccgcagcagcggggattcttcctgacaccggaggaaactttgtggggcgaataccgttcgaccagcagattcataactttgagacaacgttaaatcaggtggctagtaagtccggtggtgcagtgacaattgcagactcggtggctcgaagcttgttcttcattggaatgggaagcaacgactatctcaacaattacttgatgcccaacttccctacccgtaaccaatacaacgctcaacaattcggtgacctcttggttcagcaatataccaatcaactcaccagattgtataatctaggtggtaggaaatttatagtgtccggacttggaagaatggggtgcattcctagtattctagctcaaggaaccgacggtaaatgctcggaagaagttaaccaacttgttcttcctttcaacacaaacgtcaagacaatgatcactaatctcaaccagaatcttcctgatgctaaattcatttacctcgataccgctaatatggtccaagacatcaccactaacccagccgtctatgggtttactactttggacaagggatgttgtgggataggacggaacagagggcagatcacttgtcttccctttgaaactccttgtcctaacagagagcagtacctgttttgggatgcttttcatcccacggagaaagttaatctcataatggccaagaaagcgtttgctggtgaccgcactgtcgcgtttcctatcaacattcaggaactggctagtctcaattagagaccatcttttttattcaagaaaaagtaaaagaacttcgtgttctgtctttgtagtttgtccttgtaacgtttttgagtttctttcgtattaaaaaacttagttaaatcgttttgcctctttcagtgcattgtgaaacatatatgagaacattagcactgattcctgttacgtttttaaggttggtgaatacac

SEQ ID NO: 665 - DNA, 1060 bp, Brassica oleracea
ggaaacacacacaaaataacacacagagagacagagagagatttggttatcagatcaaaccaaaaatggggaagcgaagaggcgtctctgcagtgaacgttgtattcgggtggttgagacaccaatctaaaatggttaagatacctttagggatcatcctccctctgatcctcgtcgtgtttcttagattcaccgtcaagaatcacaaccacttctttgttgcctctgagctcatccatgccgccggaatcataatcctcatctataaactcacccgtcaaaagacttgctccggtctttctttaaagtctcaagaagtgacagcagtgtttcttgctgtgaggctgatctgcagtataagcatggaaggtgatatccatacagttctggatttcgccactttggtttcgactttgtgggtcatttatatgattcgattcaaactgaaagcatcttatgtgaagactctggacaactgccaccattactatgtgcttgttccatctgctatccttgctttcattatccacccgagtacgagatatacttacatcaaccgtgtcatgtgggcgttttgcgtttacttggaatctgtctctgttctgcctcagcttcgattaatgcagaatgctcaaatcatagagcctttcacagctcattacgtgtttgcgctaggtatcgctagatttttagcatgcgctcattggcttatccaggtctttgagactcgtggacgttacctatggctaatcggcgctggttacttctggttcccgatggctctattagccgaggccgttcaaaccttcatccttgccgacttctgctactactatgtcaaaagtgctatggagggtcagctcgtactgaagatgcccgtttagatcagtacagatgaaaaccgatacattttgttgtttttgtcaacttaagctacctgtamccaaaagtagatgcttaaaataatctaaacaggtttttttcttcattttcctgctttttgtttcagaatatttagagaagtttggtatcaaaaatagccaagaatggtctttctctc

SEQ ID NO: 666 - DNA, 574 bp, Brassica rapa
gagatcgaaaatgggaaaaagaagaggagtctccgcagtgaacgtggttttcgggtggctgagaaagcaatcgaagaaggttaagatagctttaggggtcatcctctctctgctccccgtcgtgtttcttaaattcaccgttaagaattacaatcacttctttatcgcctccgagctcatccatgcagccggaatcataatcctcatctacaaactcacccgacaaaagacttgctccggtctttctttaaagtctcaagaagtgacagcagtgtttcttgcggtgagactgatctgcagcataaacatggaaggtgatatccatacagttctcgatttcgccacgttggtttcgacgctatgggtcatttatatgattcggttcacgctgaaagcatcttatataaagagtcctgacacctgccacaattactatgtgcttgttccatctgctattcttgcgttgattatccacccgaaaacgagttataactacatacacagtgtcatgtgggctttttgcgtttactctgaatcagtctctgttctgcctcagcttcgattaatgcaaaat

SEQ ID NO: 667 - DNA, 681 bp, Brassica rapa
ggcataaaagctctgtaacatacacaaaacatagagaaagagagacagagagagatttggttatcagatcaaaccaaaaatggggaagagaagaggcgtctccgcagtgaacgttgtattcgggtggttgagacaccaatcgaaaatggttaagatacctttagggatcatcctctctctgatcctcgtcgtgtttcttagattcaccgtcaagaatcacaaccacttctttgttgcctctgagctcatccatgccgccggaatcataatcctcatctataaactcacccgtcaaaagacttgctccggtctttctttaaagtctcaagaagtgacagcagtgtttcttgctgtgaggctgatctgcagtataagcatggaaggtgatatccatacagttctggatttcgccactttggtttcgactttgtgggtcatttatatgattcggttcaaactgaaagcatcttatgtgaagactctggacaactgccaccattactatgtgcttgttccatctgctatccttgctttcattatccacccgagtacgagatatacttacatcaaccgtgtcatgtgggcgttttgcgtttacttggaatctgtctctgttctgcctcagcttcgattaatgcagaatgctcaaatcatagagcctttcacagctcattacgtgtt

SEQ ID NO: 668 - DNA, 839 bp, Brassica napus
gagagacagagagagatttggttatcagatcaaaccaaaaatggggaagagaagaggcgtctccgcggtgaacgtggttttcgggtggctgagaaagcaatccaagaaggttaagatagctttggggtcatcctctctctgcttctcatcgtgtttcttaaattcaccgttaagaattacaatcacttctttatcgcctccgagctcatccatgcagccggaatcataatcctcatctacaaactcacccgacaaaagacatgctccggtctttctttaaagtctcaagaagtgacagcagtgtttcttgctgtgagactgatctgcagcataaacatggaaggtgacatccatacagtactcgatttcgccactttggtttcgacgctgtgggtcatttatatgattcggttcacgctgaaagcatcttatataaagactcttgacaccggccacaattaccatgtgcttgttccatctgctattcttgcgttgattatccacccgaaaatgagttataactacatacacagtgtcatgtgggccttttgcgtttacgctgaatctgtctctgttctgcctcagcttcgattaatgcagaatgcccaaatcatagagcctttcacagctcattacgtgtttgcactgggaatcgctagattcttagcgtgcgctcattggcttatccaggtctttgagacgcgtggacgatacctatggctgatcggcgctggttacttttggttcccggtggctctagtagccgagctcattcaaaccttcatccttgccgacttctgctactactatgtgaaaagtgttatggagggtcagctcgt

SEQ ID NO: 669 - DNA, 1050 bp, Raphanus sativus
gggtgtctcccctcactctacaaaacgtatcatccactttcagaaacgtcgcattaaagctttgtaacatacacaaacacactaaggaagagagacagagagagatttgattatctgatcaaaccaaaaatggggaagagaagaggcgtatccgccgtcaacgttgtatttgggtggctgagacagcaatcgaaaatggttaagatagctttaggggtcatcctctctctgatcctcgtcgtatttcttagattcaccgtcaagaatcacaaccacttctttgttgcctctgagctcatccatgccgccggaatcataatcctcatctataaactcacccgtcaaaagacttgctcgggtctttctttaaagtctcaagaagtgacagcagtgtttcttgctgtgaggctgatctgcagtataaacatggaaggtgatatccatacagttctcgatttcgccactttggtttcgactttatgggtcatttatatgattcggttcaagctgaaagcatcttatgtgaagactctggacaatttccaccattactatgtgcttgttccatctgctatccttgctttcattatccacccgagttcgagatatacttacatcaaccgtgtcatgtgggcgttttgcgtttactcggaatctgtctctgttctgcctcagcttcgattaatgcagaatgctcaaatcatagagcctttcacagctcattacgtgtttgcgctaggtatcgctagattttagcatgcgctcattggcttatccaggtctttgagactcgtgtacattacctatggctgatcggcgctggttacttctggttcccgatggctctattagccgaggccgttcaaaccttcatccttgctgacttctgctactactatgtcaaaagtgctatggagggtcagcttgtattgaagatgcccgtttagatcagtacagatgaataccgatacattttgttgttttgtcaatttaagttacctgtaaccaaattagatgctcaaaataatcgagacgggtttctttcttcta

SEQ ID NO: 670 - DNA, 679 bp, Brassica napus
ggaggacatgcgctcaacgattcttcttctataactaaaagaatctctaattctctctttctctatctctacttctctctttctctttccgtggatcgatggcagcttcggttgatcctttggtggttggaagagtgattggagatgtgttggacatgtacatccccactgccaacatgtctgtctacgttggccccaaacacatcactaacggctgcgagatcaaaccctccgccgcagtcaagcctcccaaagtcaacatctccggcaaccctgatgagctttacaccctcgtgatgactgacccggacgcacctagcccgagcgagccgaacatgcgagaatgggtccattggattgtcgtggatatccccggaggcaccaatccatcaaaaggaaaggagatactgccatatatggaaccgaaaccaccggtggggattcaccgttacatatttgtacttttccggcagatctcaccggtgggtttgatggtgcagcagccgccgtcacgagccaatttcagcacccgaatgttcgctggtcatctcgatcttggtttacctgtggcaactgtttacttcaatgcccagaaagagccagcttcaggcagacgttaattccaataaacagactaaagaataacgaggagagccttttcagggtttttacccaaaaa

SEQ ID NO: 671 - DNA, 948 bp, Raphanus sativus
ggatgcgctcaacgattcttcttctataaataaaagaatctctacttctctctctttctctatctctatctctctctttctttttctctttccgtggatcgatggcagcttcggttgatcctttggtggttggaagagtgatcggagatgtgttggacatgtacatccccaccgccaacatgtctgtctacgttggccccaaacacatcactaacggctgccagatcaaaccmtcagccgcagtcaaccctcctagagtcactatctccggcaactccgatgagctttacacccttgtgatgactgacccggacgcacctagcccgagcgagccgaacatgagagaatgggtccattggattgtcgtagatatccccggaggcaccaatccatcaaaaggcaaggagatactgccatatacggaaccgagaccccctgtggggattcaccgttacatattggtactttttcggcagaggtcaccggtgggtctgatggtgcagctgccgccttctcgagccaatttcagcacccgaatgttcgccggacatctagatcttggtttacctgtggcgacagtttacttcaatgcccaaaaagagccagcttcacgcagacgttgattccactaagtatactaaagaataacaacgagcatattcagggttttatctgaaaaccggactggaaagaaatgtggcttttatatgaaccatattttataattccggtgctcgcaataatatctgtatatgtagtatagtttacatagtcatacaaatatgtttgtgtgcttgtgttacatgaagttgtttgcgtataatatatggttttcgtttgtgtgatctttgaaaattaaaattgtaaatgaacatatacatactagaatgttaacaatgaggcagacaagagattacacatcaattgtaaacgaactatatattacgc

SEQ ID NO: 672 - DNA, 699 bp, Brassica oleracea
cacccaacatctcctcacagcctccgggaaaaaacgaaacgaccgcgatgacgaagacggagtctccaccgttgcaaagaaatcttcactgatggcatgtgaagctgaccccgctgtggcgctggcaagcatccgacacgaattcggggagcacggcggagtgaacatgtccatcgaggcctccgccacctttacggtcatggaaccggacaccatgaggcggatgttcgccggagaacttggaccggaaaatgacttcttcgtatacagccgacacttcaaccccaccgtgctcaacctcagccgccagatggctgctctcgaaggcacccaagctgcctattgtacctcaagcggtatggcggcgatttcgtcggtgctgctgcaactatgcagcagtggtggacacgtggtggcttcaaagacgctctatggaggaacacacgctttgctctctcatttcttgccacggacctgcaacataaccacgtccttcgtgaacataacggaccatggcgcggtggcagacgcgatcgtcgagggtaaaacacaagtcctctattttgagtcgatggccaacccgacgctgactgtggccgacatacctgagttgagccgtatagcacacgagaagggcgtgatggtggtggtggacaatacctttacccccatggtgctgtctccggccaagtttggagc

SEQ ID NO: 673 - DNA, 830 bp, Brassica rapa
gaacaccaaaattatctgtatttcccatttccmaacagagtccctttttaactaaaaaaaataaaaatcactatggcccatatcctcaacacccaacatctcctcacaacctccgggaaaaaacgaaacgaccgcgatgacgaagacggagtctccaccgttgcaaagaaatcttcacttatggcatgtgaagctgaccccgctgtggcgctggcaagcatccgacacgaattcggggagcacggtggagtgaacatgtccatcgaggcctccgccacctttacggtcatggaaccggacaccatgaggcggatgttcgccggagaacttggaccggaaaatgacttcttcgtatatagccgacacttcaaccccaccgtgctcaacctcagccgtcagatggctgctctcgaaggcacccaagccgcctattgtacctcaagyggtatggcggcgatttcgtcggtgctgctgcaactatgcagcagtgggggacacgtggtggcttcaaagacgctctacggaggaacacacgctttgctctctcatttcttgccacggacctgcaacataaccacgtccttcgtggacataacggaccatggcgcggtggcagacgcgatcgtcgasggtagaacacaagtcctmtattttgagtcgatggccaacccgacgttgactgtggcygacacacctgagttgagccgtatagcacacgaraagggcgtggcggtggtggtggacaatacytttaccccatggtgctgtctccggccaagtttggagcagatgtggtggttcacagtatctccagttcattagtggtgggg

SEQ ID NO: 674 - DNA, 1615 bp, Brassica napus
accaaaattatctgtatttcccatttccaaacagagtccctttttaactaaaaaaaataaaaatcactatggcccatatcctcaacacccaacatctcctcacaacctccgggaaaaaacgaaacgaccgcgatgacgaagacggagtctccaccgttgcaaagaaatcttcacttatggcatgtgaagctgaccccgctgtggcgctggcaagcatccgacacgaattcggggagcacggcggagtgaacatgtccatcgaggcctccgccacctttacggtcatggaaccggacaccatgaggcggatgttcgccggagaacttggaccggaaaatgacttcttcgtatatagccgacacttcaaccccaccgtgctcaacctcagccgtcagatggctgctctcgaaggcacccaagccgcctattgtacctcaagcggtatggcggcgatttcgtcggtgctgctgcaactatgcagcagtgggggacacgtggtggcttcaaagacgctctacggaggaacacacgctttgctctctcatttcttgccacggacctgcaacataaccacgtccttcgtggacataacggaccatggcgcggtggcagacgcgatcgtcgagggtagaacacaagtcctctattttgagtcgatggccaacccgacgttgactgtggccgacacacctgagttgagccgtatagcacacgagaagggcgtggcggtggtggtggacaatacctttacccccatggtgctgtctccggccaagtttggagcagatgtggtggtycacagtatctccaagttcattagtggtggggccgacatcatcgcaggggccgtgtgtgggagcgagaagctggtgaaagggatgatggatctgcgtggcgggtctctgatgctgctgggtcctaccatgaacgccaaggtggcctttgagctctctgagcgaatccctcacttgggccttcgcatgaaagagcacagccgcagggcccaagtgtatgcagaaagaatgagggagctggggatgaaagttatatacccgggcctcacggaccacccgcagcacaaggtggctacagaaatggtgaaccgagagtacggatacggagggttgttgtcaattgacatggagacggaggaaagagccaacaagctcatgacgtatctccaaaacgccacccagtttggactcatggccgtcagtttgggttactacgaaactctcatgtcttgctccggtagcagcaccagcagcgagctcgacccctctcagaaagcagccgcaggtatctctcctggccttatacgaatgtctgtggggtatgcgggtacactggagcagaagtggacacaattcgagaaggctttcatcagaatgtaatgtcttctaccatgtctattgtggccaacgttttctatctaatgtatggtttactatctttttggcgtatttatttctcatgaatcttgcttataacttttattattaatgctatatctcttatatattaattaagaagmattataatgtaagctatatactaatatgacatcacccgtatattatttaggcaataggcatgtttttcatgccactatccc

SEQ ID NO: 675 - DNA, 542 bp, Malus x domestica
gcgggggtggaagagaaaataagggcgagagtcagaactcgcctcagagaaagaattcgaccaggaaggggaggagtaatcacctgcgacgcacttcagctaccggatctacacccgcaaccatgacgacttcaaggcgtttggctgacaggaaggtggagaggttcgagaagaacataacgaagagaggggcggtgcctgagacgaccgccaagaagggcaaggattatccagtgggtcctattctccttggcttcttcgtctttgttgtcatcggatcatctctctttcagataatcaggactgctacaagcggaggcatggcctaatcgaatcgacgctgctgctgctgatgctttctaatttatgagagatggcatgaacctgtcatgccgtttaccatttgttagcgattaggaaactgatgatatacagatgtgatgtagtaagaactaaaacagtggtgtttctatcttgtgaagagtaagaagtttgaataaaggatcccttcctctgctccgcttaattctaaaaaaaaaaaa

SEQ ID NO: 676 - DNA, 540 bp, Malus x domestica
acgagggagagtcggaactcgcctgcaagagagagaattcgacgaggaaggggaaaagcctgcacgaggagaattaatcacctgagacgcacactcagataccggatctacacccacaaccatgacgacttcaaggcgtttggctgacaggaaggtggagaagttcgagaagaacataacgaagagaggggcggtgcctgagacgaccgccaagaagggcaaggattatccagtgggccctattctccttggcttcttcatctttgttgtcatcggatcatctctctttcagataatcaggactgctacgagcggaggcatggcctgatcaagttgaccctactgatgcagctgctgctttctaagttatgagagatggcgccaacctgttgtgccgttttactgttttgttagcgaataggaaactgatgatatacaaatgtgatgtagtaagaactaaaacagcggtgtttctatcttgtgaagtgaaagaagtttgaataaaggaccccctccactgcttcgcttaaaaaaaaaaaa

SEQ ID NO: 677 - DNA, 421 bp, Persea americana
  misc_feature (17)..(17): n is a, c, g, or t
ctccttcgttttctccngacgcaaggaaaaaatgacaacttcaaggcgccttgctgacagaaaagtggcgaagtttcagaaaaatatcacaaagaggggatctgtccctgaaacaacagtaaagaaaggcaatgactaccctgttggtccaattgttctcggcttctttgtctttgtggtcattggatcatctctttttcagataattagaacagccactagtggtggagcggcctgaggtaatggacaatgttcttatgggaatggatgctcatggatctactagtgataatatatctattaaagtctactgtgttgggaaagagtggatagattaaaatcatttatgttggttaaaatactagttctttataaatgatacctcccgctatatctaaaatctaaactagtgttccatttt

SEQ ID NO: 678 - DNA, 603 bp, Brassica juncea
gctagcagacaggaagatagagaagtttgacaagaacattactaaaagaggttttgttcctgagaccaccaccaagaagggtaaggactaccctgtcggacccatcctcctcggcttctttgtcttcgtcgtcattggttcatgtgagtattcctaaatctcttttagctttgattatgttggaaagcatcttagtgttgactcctggtttccaaataacgaacatggtcttgaatatggattatttggttatataataatatattgtgtgttacactagtatatgttgattaacttttgtatgcgctttgttacagctctcttccagatcatcaggactgcaactagcggaggcatggcataaacgaaaccacttcttctttcttgtctcacttctcccttaatcttattgtagaatgctttagctttctgtgtactttactacatgttgtgaagaattttgagtcttttctatataaaattatcaaaccttttaatgttgtcttgaagttagttgccgttgttgtcatgcttctgtaatcttgttttaccggtttatcaactgggaccgaatatgtctatgcatgtaagaatattattggg

SEQ ID NO: 679 - DNA, 377 bp, Brassica juncea
gctagcagacaggaagattgagaagtttgacaagaacataactaaaagaggttttgttcctgagaccaccaccaagaagggcaaggattaccctgttggacccattctcctcggcttctttgtcttcgtcgtcattggctcatctctcttccagatcatcaggaccgcaactagcggaggcatggcataaatcgaatcacagttcaagctatagaggaagcgatgttttcaaattggatctctcttcttcttcttttgtcttgactgtttttcccttatactgcaaaatgcgttaactttctgtttactactacatgttatgaagaattttgagactatttttttctataaattatccaatcttggaaaaaaaaaaa

SEQ ID NO: 680 - DNA, 559 bp, Brassica juncea
ggaaaaaagaaagtcaaaagaaaacgcggagagtttgttttatccttgtgctcgcgagatcgtcaattcgattcctttttcgtttcttctccggcgtaatcatgacaacttcaaagaggctagcagacaggaagattgagaagtttgacaagaacattacaaaaagaggttttgtgcctgagaccacaaccaagaagggtaaggattaccctgtcggacccatcctcctcggattctttgtcttcgtcgtcattggttcatctctcttccagatcatcaggactgcaactagcggaggcatgtcataaacgaaatcgctctcttctttcttgtgtcacttttcctttaaccttaccgtagaatgctttagctttctgtgtacttactacatgttgtgaagaattttgagagtcttttctatattaattatcaaaccttttaatgttgtcttgacgttagttgccgttgttgttgtcatgcttttgtaatctttttttttaccgctttatcaattggaccgaatattaatacatataagaatattgttggaaaaaaaaaa

SEQ ID NO: 681 - DNA, 496 bp, Brassica rapa
gggtgacaggcaggagaaacagaactctctttaagacaaagacaagtttctctccgacacggcgaacgtcaattccgattcactcatcccttcttagtgtttcttctccggcgtaataatgacaacttcaaagaggctagcagacaggaagatagagaagtttgacaagaacattactaaaagaggttttgttcctgagaccaccaccaagaagggtaaggactaccctgtcggacccatcctcctcggcttctttgtcttcgtcgtcattggttcawctctcttccagatcatcaggactgcaactagcggaggcatggcataaacgaaaccacttcttctttcttgtctcacttctcccttaatcttattgtagaatgctttagctttctgtgtactttactacatgttgtgaagaattttgagtcttttctatataaaattatcaaaccttttaatgttgtcttgaagttagttgccgttgttgttgtcatgg

SEQ ID NO: 682 - DNA, 490 bp, Phaseolus vulgaris
gctcggatcgcacattcacacacgcgagaaaataaggttggagagggcgctgccggaggaacaccgtcttttattttccggccatctcttgtttcttccaccactcggcgatcccgtttctctgacaccaaacatgacgacatcaaggcgctttgctgacaggaaggtggagaagtttgagaagaacattaccaaaagaggatttgtgccggacacaacctctaaaaagggaaaagactatcctgttggtccactgctgctgggtttcttcgtctttgttgtcattggttcatctctcttccagattatcagaacagcaacaagtggaggcatggcttaatggagcattgttttggaatgtatcatcttttctttcttagcctcgtagaaaatgccaatacttccctacatctactgtacttgtaccagacccggttccggttcatgttttgatgagctttaataatttttaatttacattaaaaaaaaa

SEQ ID NO: 683 - DNA, 471 bp, Brachypodium distachyon
tcccagcagcccaactcctcccctccctcatccagctcccctacgtccccggccgccgacgagctcagcagggatcttgcgactcgcgaagatgactacttccaggcgccttgctgacaggaaaactgccaagttccagaagaacattaccaagaggggttcggtgcctgaaaccactgtcaagaaggggaatgactatcctgttggacccatagtgcttggattcttcatctttgtggtcatcggatcatctctgtttcagataatcaggacagcgaccagcggcgggatggcttgagaatgaggatatgcagaagatttgtcgccgtagcagctaaaaaccattcgttgttggcgtagtgtgttcctgtgtgttatgagcttcctcgtcttatagtaccagggtctaaaatgatgtttgatgaactgtaaacagagctaagttatcaatcttatacatgttaaattgat

SEQ ID NO: 684 - DNA, 492 bp, Manihot esculenta
gggttttagtcttcaaattatcaggcacagagcggaactcggaagacagcaagtggaattgcaaaactcaccggaggagggagaaacgttctcaatctctaatatctcagaaactctctagcttcaatcgctcccggctatcagatctccccgtgaacatgactacatcaaggcgccttgcagataggaaagttgagaagttcgagaagaacattactaagagaggagctgttcctgaaacaactactaaaaaggggaaggactatcctgttggccctgtcttgcttggattcttcgtatttgttgtcattggatcatctctattccagataatcaggacagctacaagtgggggcatggcataaatgtatacagacttttgagagatgggaagatgatgttagcatgtagttgatatatgggaaatacttgttgagttgttattcatgttctgaacttttttttatcttaataaaattgccctttcctttt

SEQ ID NO: 685 - DNA, 410 bp, Manihot esculenta
gaggagaaggaaggagatcatctctaatctctcgttaagctctctcgctccaacctttttccggctatcagatcaccctgtaaccatgactacatcaaggcgccttgcagataggaaagttgagaggttcgagaagaacattactaagagaggagctgttcctgaaacaactactaaaaagggaaatgactatcctgttgggcctgttctgcttggattcttcatctttgttgtcattggatcatctctattccagataatcaggacagcaacaagcgggggcatggcttaaatgtagacggagagatggaagatgacgttagcttatagttgaaacatgggaaatagttgatgacttgttattcatgttgagaactctgttatcttaataaagatgcccctaatttttt

SEQ ID NO: 686 - DNA, 739 bp, Ricinus communis
taatttttcgttgaggtttctcgctccttccagatctccccgtaatcatgacaacatcaaggcgacttgcagataggaaggtggagaggttcgagaagaacataacaaagagaggaacagtgcctgagacaactacaaagaagggaaaggactatccagttggccctcttctgcttggtttcttcattttcgttgtcattggttcatctctattccagataatcaggacagcaacaagcggtggcatggcataaatgtagacagcatattttgagagatgcaagaaatgttagctttgtagttgaatgggaaaatgactttattttattttcttacttgttctgaaactcggtaactataaaataataaaatgatccttcctcataatatttaaatatatgatttttttttttttcctttacgatgaattttataggaaggcatgttgatggtgttccattgtatgctttcacaatagctatatcctttttattggcatgcgagtttggaatcaagcttatggcatgatatgctacgttgatgcccattcgtaaagacttgtcagtggttttgttgaagaattggatgctgggggttgggctgtctgtgaagttggtgcttcctaattgagcattattatttcttttcctctatgtattcatctttgtggcatctgagacgggaaacgcctctgacttgtatggagaactctgaaatattacagaagccttctctttta

SEQ ID NO: 687 - DNA, 496 bp, Centaurea maculosa
gcgggggaattggaataggaaattctcgttgccggaaatcgagaagaatagccttctacaatctcaaaatcatgacgacatcaaggcgtcttgcagataggaaggtggagaagttcgataagaacatccttaggcgtggttcagtccctgaaacctttgccaaaaagggaaagagctatcctgttggtcctcttatgcttggctttttcgtctttgttgtcatcggatcatctctgtttcagataatcaggacagctacaagtgggggcatggcttaattgctgcatctggcttaacaccaccttgctgaatggtcctaaaactgtaaaacctgatcttaccacttaatcaaatcagcagcattgtgaccaaccgagtgtaaaatctgttgttttttagtttctacaataatggctaaaatgacgatgtaaacgttactccttatggcttgtagtcgggttttcacaatctttaaagcaatttcaccttcatcacc

SEQ ID NO: 688 - DNA, 482 bp, Centaurea maculosa
ccaacaactcttctttctaaattctctctctaatctcaatcgattgaagatttgcagatcagatcgatcgatctttcgaagctacaatgactacatcaaagcgtttagctgatagaaaggtggagaagtttgagaagaacatcaagaagcgtggttctgtgcctgaaacaacaacaaagaagaaggattcttatcccgttggtcctatcgtgcttggtttcttcatctttgttgtgataggatcctctttgtttcagataattcgcacagcaacaagtggaggcatggcttgaagacttgaagttgtaggtggtcgtctgtttgttagttaaagttgtctttatgtaagctaaacaggttgtgatatgttgatggagtggtacgtttgttgtgactcggagatatattatatataactcaataagttatatgacataatatttacaaaagagaaaaagagtaatcatgtttttttttttccg

SEQ ID NO: 689 - DNA, 1218 bp, Citrus sinensis
gcggggggggaggctatcawtatcttccctgagctgatctcatataaarcgtaccagacrgttttgcgagggagagtatagaaaggggagaagcgacccgaatcggaagtcgtcttcgccggaagggttaagagaagcaatagcctgtgtttcgcctacgatttctttcttgatacatccgttcctggctaccggatctctccgtcatcatgacaacgtcaaagcgtcttgcagtgaggaaggtggacaaatttgagaagaacattatgaagagaggcgccgtgcctgaaaccaccaccaaaaagggcaaggactatcccgttggccctgttctgcttggcttcttcgtatttgttgtcattggatcatctcttttccagatcatcaggaccgcaacaagtggagggatggcctaattatccatcaatacggagaagtagcaggaaatggcctgaaacgttatttacttttctttttttagtttgtagaaatacctgatgatacttctacaagtccagtgttcattatgtgttatggagaactcagattttgaataagatcattgttcttttatctttttggtttccttgttcatgcggatggataattgtggacgttaatgctgagttccacttgtgtggagcgtgaactagtgtactatattaacgctttggagtttttagtctttttatttgtttcgtcaaaattttgtaattcttactaagcattgttggttaccaaggctgctgttgggttttctgacaaaaaaacaaaaaaaaaaaaccccacctttctgtacaaatttggcttatgaaaaaagcatggctttcattttgttggcaagaacaggtcccttccgtcaaactaaactccttttttggcccccgcctctatcccccccttggaatcctaatacatgattccaagcatcttcctgggagcagcaggccccttttgcctaatcccctaaaatatgattcgcacagatatcatccaattgtcctccacgacctatcctactaccatgctatacgccgctgcaccgacccccggccccaccctccacatcctcccttgtaatacacctcctcactgctggagctaggaggacacaacaacacgaggtagacatctcaaatcacgggagcaattcctggcactctggcccttgcattgcccgcgtacgtcgtggctctaaaaccgcgcgcgatatctcac

SEQ ID NO: 690 - DNA, 529 bp, Citrus sinensis
agagaagcaatcgcctgtgtttcgcctacgctttctttcttgatacatccgttcctggctaccggatctctccgtcatcatgacaacgtcaaagcgtcttgcagtgaggaaggtggacaaatttgagaagaacattatgaagagaggcgccgtgcctgaaaccaccaccaaaaagggcaaggactatcccgttggccctgttctgcttggcttcttcgtatttgttgtcattggatcatctcttttccagatcatcaggaccgcaacaagtggagggatggcctaattatccatcaatacggagaggtagcaggaaatggcctgaaacgttatttacttttctttttttagtttgtagaaatacctgatgatacttctacaagtccagtgttcattatgtgttatggagaactcagattttgaataagatcattgttcttttatctttttggtttccttgttcatgcggatggataattgtgcacgttaatgctgatttccacttgcgtggagcgtgaactagtgtact

SEQ ID NO: 691 - DNA, 585 bp, Coffea arabica
ctcctctgagaagtatgttcacgtttgtttataaatagcgaatgaattagtggccacctgatttttaatcatttgatcgccggagaacagatcacccgagaaatctccggcgctttgtctcatttcaattgttcttagcagtttgacccccccctgcaacaatgactacatcaaggcgtcttgctgataggaaggtggagaagttcgagaagaacatcaccagacggggagcagttcctgaaactagtacaaagaagggaagcaactaccctgtcggccctatcttgcttggtttcttcgtttttgtggtcattggatcatctatattccagataattaggacagcaacaagtggaggaatggcttaaccgtccagtggtcaattgaccaaataccggctgccagttgtagtgtttttttttttgcctgttagcaggcaaatgtagaaattaaagtgaatcgtarctagatwaaactttgtttgtgtttaaaagactgatggaacacacagtttttsttatatagctgaaccttttctcattcaatcgttgttgtgcttttttgcctgttgagtcaaatttgggt

SEQ ID NO: 692 - DNA, 615 bp, Gossypium hirsutum
gggcccgtcttcagcactatttaaagcggatggatagctgacatcctctatcaaatccggacattttcgcgagaaagtgagagatcgagagagaaaatacttcgcagggaattagcgagatcctgaaattttcctgcgttttctctcttcaatcttctccggctacctgatctatccgtcatcatgacaacatcaaggcgtcttgcagaaagaaaggtggagaagttccaaaagaacataacaaagagaggagctgtgcctgagacaaccacaaagaaggggaaggattatcctgtcggtcctctgcttcttgggttcttcatattcgtcgtcattggatcatctctcttccagattatcaggacagcgaccagcggaggtatggcataagtctgcacttctgatgttaaggaattgcgaggagactggtcatgcattgggctttgcttttctgttcgttttgtagggaaaaactgaagatatatttactagagagatatgcttacgatgtgaaatgtttggaatttgaataagacctcccctttagttgtctgttcattgtgctttgtctgctacttttttcatttatgcaatgagatggactaaatactgata

SEQ ID NO: 693 - DNA, 485 bp, Mesembryanthemum crystallinum
gcacgaggaagttttagagagaaggtgaacgcgttttcgtcgttgtttgggcggagagagaaaatccctcttcaccttctccgagcaaatccctgcaaattaatttctctccatcgctaccgtaacttcaaccaaacatgactacttcaagacgccttgctgacaggaagagcgaaaagttccagaagaacattacaaggaggggctctgttccagagaccactgtcaagaagggtgcagactatcctgttgggcctgttctgttgggtttcttcgttttcgttgtcattggttcatctctgttccagatcattaggacagcaaccagcggaggaatggcttaaatacacaataagatgtgaaggctctctcgcttatgtttagattacaggatagaagaaagtcaaaaaatatgtactagatcaatgttgtatcgttgttggaacccaaattttgaaataaagatgcagtgatgcacattctct

SEQ ID NO: 694 - DNA, 700 bp, Ipomoea batatas
cggggatacgataattgtaaacgatcggagcgagagaagagagagaaatcgcctcgtcgccggagaatcgcaggtactcagctgtcacgaaaattctccggtgtttttcgtcctaattgtattacgcccaccggatcttccattaaacaatgacaacatcaaggcgtcttgcttccagaaaggtggagaagtttgagaaaaacatcaccaagcgaggatttgtccccgaaagcactacaaagaagggaaacaactatcccgtaggacccatcttgcttgggttcttcgtttttgttgtcatcggctcatctctattccagatcatccggacagcaacaagcgggggaatggcatgagttttgacgtagacaactagacaatgaatggctgcctgtttttagtgtcttttcccatgttccttagtttaaagtactctcaagtggtaaaatttttcgagacatgtatgttgtaagtgattggttgtcaagttacgtgatcattaattagacaatcaatgttggttgttttatttatttatttttaaaaacctaattatatcacaacactgttacgttatacaaaaaattttgccacaaaaacacatgtatcactcaaaagtatacctttattagtattgtttctatgatgatttaataagttcakaattaataaagtttcagttgtgttggttcctgaaaaa

SEQ ID NO: 695 - DNA, 533 bp, Lactuca sativa
ggtataataagacggtccaccgctatttgagaacctcctctaaatcgcaggcgctggtttctgaaagagttgggaagttggaacatacactccacaaactcttcataaattctctccaatctctggagatcgatcaaagattagcagatctgatccttggaagctacaatgactacatcaaagcgtttggctgatagaaaggtggagaggtttgagaagaacatcaagaagcgtggttctgttcctgaaactacaacaaagaaaaaggactcttaccctgtgggacctattgtgcttggtttcttcatatttgtcgtgataggatcctctttgtttcagataatccgcacagcaacaagtggaggcatggcttgaatgggtcgatagagtcggttactttcaaatgggtagatcctactttggtttatggtttgttttgttagagctaaagttaagttaagttgagttaaggtctgtctgttgaaggattgttgtgactactgagatataactcaataatcttatataaaatc

SEQ ID NO: 696 - DNA, 600 bp, Lactuca sativa
cgggggcggtataataagaaggtccaccgtatatgaggacctcctctaaatcgcaggcgctggtttctgaaagagttaggaagaacatacaacccacaaactcttcataacttctctccaatctctcgagatcgatcaaagattagcagatccgatccttcgaagctacaatgactacatccaagcgtttggctgatagaaaggtggagaggtttgagaagaacatcaagaagcgtggctctgttcctgaaactacaacaaagaaaaaggactcttaccctgtggggcctattgtgcttggtttcttcatatttgtggtgataggatcctctttgtttcagataatccgcacagcaacaagtggaggcatggcttgaaacttgaatgggtggatagagtcagtttctttcaaatgggtagagcctactttattttatggtttatggtttgttttgtttgagctaaagttaagttaaggtcgtatgttgaaggattgttctgactattgagttataactcaataaactatataaaatcttagttaaaaaaaaacaaaggtcctttttttactttatggctgtttataattcattgaggcac

SEQ ID NO: 697 - DNA, 541 bp, Lactuca sativa
gcggtataataagacggtccaccgtatatgagaacctcctctaaatcgcaggcgctggtttctgaagagttaggaagaacatacaacccacaaactcttcataaattctctccaatctctcgagatcgatcaaagattagcagatccgatccttcgaagctacaatgactacatccaagcgtttggctgatagaaaggtggagaggtttgagaagaacatcaagaagcgtggctctgttcctgaaactacaacaaagaaaaaggactcttaccctgtgggacctatagtgcttggtttcttcatatttgtggtgataggatcctctttgtttcagataatccgcacagcaacaagtggaggcatggcttgatacttgaatgggtggatagagtcagtttctttcttccaaatgggtagagcctactttgttttatggttttatggtttgttttgttagagctaaagttaagttaagttaaggtcgtatgttgaaggattgttgtgactactgagatataactcaataaactatataaaatc

SEQ ID NO: 698 - DNA, 545 bp, Lactuca sativa
ggcgggggcggcgctggtttctgaagagttgggaagttggaacatacactccacaaactcttcataaattctctccaatctctggagatcgatcaaagattagcagatctgatccttggaagctacaatgactacatcaaagcgtttggctgatagaaaggtggagaggtttgagaagaacatcaagaagcgtggttctgttcctgaaactacaacaaagaaaaaggactcttaccctgtgggacctattgtgcttggtttcttcatatttgtcgtgataggatcctctttgtttcagataatccgcacagcaacaagtggaggcatggcttgaatgggtcgatagagtcggtttatggttcgttttgttagagctaaagttaagttaagttgagttaaggtctgtctgttgaaggattgttgtgactactgagatataactcaataatcttatataaaatcatatttcccccttgtggcgggggggaaaaaaaaaaaccatgggggccgcctcggcccaatcatctctaaacccgggcaagttt

SEQ ID NO: 699 - DNA, 521 bp, Lotus japonicus
gaagcttcaataaataaataaataaaacgcgcaaataactcctcacacaatctcagaaagagtcacggatcggatcggatcggatcggaacggaacaccgcaccaccaccgtcttccaccactttccggcgatcccctatccccgcaacaaaaacatgacaacatcaaggcgccttgcagacaggaaggtggagaagtttgagaagaacatcacaaagagaggatttgtgccagaaacaaccgctaagaaagggaaagactaccctgttggccctgtgctgctcggtttctttgtctttgttgtcattggatcatctctctttcagataatcaggacagcaacgagtggaggcctggcttaatggagctttgatttggacttgtgttatcttctctttcttagcccttgtagacaatggccatactttcctacatgtacttgtactagaaccagttcctgttcatgttttgatgaaccttaaggatttttaatttatataaccactgtgtctcttctcttt

SEQ ID NO: 700 - DNA, 578 bp, Medicago sativa
gagagtcactgccggaaaagaacatcaccaccgtctttcaattttccggcgatctcttcgtttttccaccggcgatccattatcctcccaatcaatcatgactacatcaaagcgccttgcagttaggaaggtggagaagtttgagaaaaatatcacaaaaagaggaagtgtgccagaaacaactgttaagaaaggaaatgactatccggtcggccccgtgttgcttggtttcttcgtctttgttgtcattggatcatctctctttcagataatcaggacagcaacgagtggaggcatggcataatggagctttgagttggactgtattatctttttcttagccctgtagaaaatatgactatacttttctacatgtacttggactatacccagttcctgttcatgttttgatgaagttttaaggatttttaaaattttaattatacaagtattgcacctcttttgtttaatttacataatgcgacagattgattttagtagttagttatgaatatgacaattgatgctgtgtaatcgtgagggattagtcatggtataaatggtaacgagtctcacat

SEQ ID NO: 701 - DNA, 496 bp, Capsicum annuum
ctctctctctctctctctctctctctctaaataaattggggcacaacaacaattctctctctctctctgccaattttcatatattggggattttccttcaagcatgactacatcaaggcgcctcgctgataggaaggtggagaggtttgagaaaaacatcaccaagcgaggagctgttcctgaaactaccgctaagaagggaaaccagtatcctgttggccctatcttgcttggcttctttgtctttgttgtcattggctcatctttgttccagataataaggacagcaaccagcgggggtatggcttaagcgtgcaaagtgatacaaatagcggtggtgataggctacgcctgcttgttgtagtgttttatcctcaaagttcagcccaatgttgaaattgaagagaaacttctgtacgaattgtgattttcatttatgagactcaaatataaactttctcccatctcccatcatttatacttgcctagtttggtt

SEQ ID NO: 702 - DNA, 606 bp, Vinca minor
actagtggatccaaagaattcggcacgagggaaggaataagaaggaggaggtcgccgcgtttttcatctgccggagagtcgatcgcctgaaaattctccggtgttccttgttccatctattcgtcggaagcttgatctcctagtaaccatgacaacatcacgacgcctagctgataggaagatagagaagttcgagaagaacattaccaaaagaggttctgttccagaaactactgcaaagaagggaagcaactatcctgtcggcccaatcttgcttggtttcttcatttttgtggtcattggatcctctctgtttcagataatcaggacagccacaagtggaggcatggcctaattgttcttatatgactttgtgattcatgcagatgaatcttgttatagtttcgttgcccattggtagttcaaaatgtagaaaccaaaagactcatctgttatcagtttctttcacaattgttagttcaaacaaatgtaggaaccaaaaagactcaatgtgatcagttctttcactatcatgtttgaaataactgatgaaatataaatctttttgtttagtawamwraaaaaacctcgtgccgaattctttgg

SEQ ID NO: 703 - DNA, 495 bp, Petunia x hybrida
ggaatcaaaataataaatataagtkrrraataatttgggagcagagaaaaaagaawwwwtattacctgaataatttctctgcaaaatctctcttgttttctcatcaccggatttttcatcaattatgacgacctcaagacgtctagctgataggaagatagagaggtttgagaaaaacattaccaagcgaggagctgttcctgaaactaccgcaaagaagggaaaccagtatcctgttggtcctatattgctcgggttctttgtctttgttgtcattggctcatctttgttccagataatcaggacagcaacaagcgggggcatggcttaagcatggaacaagttatacaagtgctgtggtgatataggcttttatgccaycttcttgtagttttgtttttctcaaagtttagcccaatgtagaatttgaagagaaacttttggtgtagaacctgtgttttaacttgtgagataatataaattttctcctgtctc

SEQ ID NO: 704 - DNA, 562 bp, Solanum tuberosum
cgtcgatttcttcgccacctataaaatatttcaacaacagttgaacttcaatcaataagacaaaataaaattggggcaaagaaaagaaggaacaacttttagctgaaatataattctctctgcaatttttctgttctcatatatcggcggccaccacattttccttcaaaaatgactacatcaaggcgtcttgctgataggaaggtggagaggtttgagaaaaatattaccaagcgaggagctgttcctgaaactactgcaaagaagggaagccagtatccagttggccctatcttgcttgggttcttcgtctttgttgtcattggctcatctttgttccagataataaggacagcaaccagcggcgggggtatggcttaagcctgcaaagttatacaagtagtagcgcctgcgttgttgtagtagtgttgttttcctctaagtttagctcaatgtagaaactgaaaaaaaaaaatcggtaggaatgtgtttttaatttgtgagactcaaaatataaattttctcgtctcattatatggttatgtttgtgttctccatcgtt

SEQ ID NO: 705 - DNA, 580 bp, Raphanus sativus
gggaaaaaaaacaagttaagaaaaacaaaagaaaacgcggagaggttatattacttgtgctcgcgagattcatcaattcgattccttgttcgtttctcaccggcgtaaatcatgacaacttcaaagaggcttgcagacaggaagatcgagaggtttgacaagaacattactaaaagaggttttgttcctgagaccaccaccaagaagggcaaggattaccctgtcggacccatcctcctcggcttctttgtcttcgtcgtcattggttcatctctcttccagatcatcaggaccgcaacaagcaaaggcatggcataaacggaatcactgttcaagcttagaggaagcgatgttttcaaaattaatctcttcttcttcttctgtcttgactgtttttcccttatactgtagaatgcgttaactttctgtttacttacatgttatgaagaattttgagactacttttttctataaattatccaatctttgaaatcttgtcttgaacttagttgccaatgctgttgttgttatgatgcttttgtataactacttgttgacttacctcaacttggttcgccca

SEQ ID NO: 706 - DNA, 491 bp, Raphanus sativus
tttttaaaaagacgggagagaaaacagattttgaaaaaaaacaaaaaagaaaacgcggagaggttatttacttgtgctcgcgagattcatcagttcgattccttggtcgtaatcatgacaacttcaaagaggcttgctgacaggaagattgagaggtttgacaagaacattactaaaagaggttttgttcctgagaccaccaccaagaagggcaaggattaccctgtcggacccattctcctcggcttctttgtcttcgtcgtcattggttcatctctcttccagatcatcaggaccgcaacaagcaaaggcatggcataaacggaatcactgttcaagcttagaggaagccatgttttcaaaattaatctctcttcttcttctgtcttggctgtttttcccttatactgtagaatgcgttaactttctgtttacttacctgttatgaagaattttgagactacttttttctataaattatccaatctttg

SEQ ID NO: 707 - DNA, 486 bp, Raphanus sativus
ggaaaattagaagaaaagaaaagaagtttgaggcattttgttcggctagcgatctgtgaatttcgattccttccttcctccaccaagattgtttcttctccggcgtaaaacaatgacaacttcgaagaggcttgcagacaggaagattgagaagtttgacaagaacattactaaaagaggttttgttcctgagaccaccaccaagaagggcaaggattaccccgtcggtcccatcctcctcggcttctttgtcttcgtcgtcatcggttcttctctcttccagatcatcaggaccgcaacaagcaaaggcatggcataaacggaataactgttcaagctagaaggatccattttgcaatatgagaaggctgctctcttcttccgtcttgtctcttttcccctcctttatactaattgtagaatgcatcaactttgtatttacaacatgttaatgttatcaagaatatttttcttttcaagtttaag

SEQ ID NO: 708 - DNA, 435 bp, Rosa hybrid cultivar
gaaagagtttgcgatagcgaaaaataagggcgagaaagttcagactcgcctgaaagaagaagaagaacaaggaagggcttgatcacctgcgacgcactctttctcccaaccgcaacagcaacaacaacaatgacgacttcgaggcgactggctgataggaaggtggagcggttcgagaagaacatcaccaagagaggcgccgttcccgagacgaccgccaagaagggcaaggattatcccgtcggccctattctcctcggcttcttcatcttcgttgttgttggctcatctctgtttcagatcatcaggactgctaccactggaggcatggcctaaattgagcctgctgcttgtgctgagtttctaagttatgaaagagatggtgttagatcgaatcattgtcgtgtcgtgtcattttactttttctttttggta

SEQ ID NO: 709 - DNA, 601 bp, Carthamus tinctorius
cctttgtgatcttctctcatcatcgaattcggaattaggaattagcagcattctaccatttcatcaggcaatatctcctcaaaaatcatgacgacatcaaggcgtcttgcagataggaaggtggagaagttcgataagaacatcgttaggcgtggatcagtccctgaaacctctggcaaaaagggaaagagctatcctgttggtcctgttatgcttgggtttttcgtctttgttgtcatcggatcatctctgtttcagataatcaggacagctacaagtgggggcatggcttaatggctgcatctggttaaccaccatcttgctgaatgggtcctaaaactgtagaacctgatgttaccacttaatcaaatcagcagcactgtagccaactaagtgtatctacaataatggctaaaatgacaatatataacctactcctttatggcttgtagtcggatttcatctttcatcactcagaaaaattgtgttataaaaagagctatatctacattttaatactcratacttgtagttttagaacaattagtagaggtgttgttttagatctttgatctattcaatcaattgattcttcaaaaaa

SEQ ID NO: 710 - DNA, 405 bp, Carthamus tinctorius
ggcgttacgtttcaaactgctttgcasgcgctggttttctctcagaaccaaaccccaaaagccaacccctcaactctcctgcaaatcttcaccaacctatctactctaatgacaacatccaagcgtcttgcagatagaaaggtagagaggttcgagaagaacatcaagaaacgyggttcagtgcctgaaacgacwacaaagaagaaagactcctaccctgttggccctatagtgcttggcttcttcatttttgttgtcataggatcctctttgtttcagataatacgcacggcaacaagcggaggaatggcttaaagtgttgctggtcctgttctgttattggtatttattatatgttagagaacgtaaaacatggattattggtgagtttcttaattaaggctt

SEQ ID NO: 711 - DNA, 459 bp, Carthamus tinctorius
  misc_feature (458)..(458): n is a, c, g, or t
ggggacaaatagctccttgtaattctctctaatctcaatcccatccaagatttgcagatcagatctttccaacctacaatgactacatcaaagcgtttagctgatagaaaggtagagaagtttgaaaagaacatcaagaagcgtggttccgtgcctgaaacaacaacaaagaagaaggattcttatcccgtcggtcctattgtgcttggtttcttcatcttcgttgtgataggatcctctttgtttcagataattcgcacagcaacaagcggaggcatggcttgaagacgtaggtttgtttgttagttaaagttgcctttatgtaagctaaacaggttgtcatatgttgaatgagtggtatgttttgttgtggctcggagatatattatatataactcaataagttatcacatataatatttacaaaaaaagaaaagagtaaatcatgtttttcgtcna

SEQ ID NO: 712 - DNA, 718 bp, Glycine max
ctattatcggggagccactaaattaaaaaataaataaatactactagtgaaagggtgaaacaacgaaaaaccgtgtttcactcggatcgcgcattcacaaataaggttgaagagggccctgccggaagaagataaataccgtctttcattttccggcgatctcttttttcttccatcaccgttttccggctatccctaatccttaacagaaatgacgacatcaaggcgccttgcggacaggaaggtggagaagtttgagaaaaacatcaccaaaagaggatttgtgccagacacaaccactaaaaaggggaaagactaccctgttggcccagtgctgctcggtttcttcgtctttgttgtcattggatcatctctcttccagataatcaggacagcaacgagtggaggcatggcttaaatggagctttattttggattgtgtcatcatctcttagcctcctcgtagaaaatgctaatacttctctacatgtactgtacttgtactagacccggttcctgttcatgttttgatgaacttttatggatttttaattaaaaatacaactattgtttgtcttgtctttaattttaccgaagggaatggggggacctaattacttacgttggggtgaatattatagtgcttgcaaaaagccaaagctgcccatggtggggagtgagactaaagaggtttttgaaccaccaagactgttttatt

SEQ ID NO: 713 - DNA, 523 bp, Glycine max
ggatcgcgcattcacaaataaggttgaagaggtcactgccggaagaagggagcaacaccatctttcattttccggcgatctcttgtttcttccatcatcaccgttttccggcgatccctaatcctcgcaaacagaaatgacgacatcaaggcgccttgcggacaggaaggtggagaagtttgagaagaacatcacaaaaagaggatttgtgccagacactaccactaagaagggaaaagactaccctgttggcccagtgctgctcggtttcttcgtctttgttgtcattggatcatctctcttccagataatcaggacagcaacgagtggaggcatggcttaaatggagctttgttttggattttgtgtcatcttctctttcttagcctcctcgtagaaaatgctaatacttctctacatgtactgtacttgtactagaccctgttcctgttcatgttttaatgaactttataagaattttgaattaaaaatacaactattgttcgttttgtctttaattcta

SEQ ID NO: 714 - DNA, 466 bp, Euphorbia antiquorum
aaaaagaaagagagaaggagagaaagatctcgccgtcgctggaggtggaagagaargatccgcctgtaatttctcgttaggctttctcgatcgtttcgttaccggttgtcagatctcccgctaaacatgactacttcaaggcgccttgcagataggaaggtcgagaagtttgagaagaacattatgaagagaggatttgttcctgagacctctaccaaaaagggcaaggattatcctgttggccctgttcttcttgggttctttatcttygttgtcatcggatcatctctattccagataatcaggacagcgacaagcggaggatattgagaggcagaaagaaagtttagcttgtagttaaaatggaaattaccttcattacattactattgtayaacttaaactagttttgtttgaaactgarttatctttcttaataatactctttacttacctttgttctttc

SEQ ID NO: 715 - DNA, 610 bp, Fragaria x ananassa
  misc_feature (598)..(598): n is a, c, g, or t
  misc_feature (610)..(610): n is a, c, g, or t
gcgaaaaataagggcgagagaactttcagactcgcctgaaaagaaagaagaagaagaaccaaagggaaggaagggccataatcacctgcgacgcgcactctttctcctccgcaacctgaacagcaatgacgacttcgaggcgactcgcagataggaaggtggagaggttcgagaagaacatcaccaagagaggggcggtgccggagacgaccgccaagaaggggaaggattaccccgtcggccctattctcctcggtttcttcatctttgttgttatcggatcatctctgtttcagatcatcaggacagctacgactggaggcatggcctaaattgagcctgctgcttctgccgagtttctaagttatgagagagagatggcattagatcgaatcattgtcctgtcagtgtggttttactttttctttttgttagctagtagaaaaaacaactgatatacaagaatgtgatctagtactacaagctgtggtttctaccttgtgaaggaaagaaaaaaacttctatgtagacgttatgaagtttaaataataaactaccccttcctatataattcatttatctgttacattttatttgnatttttccaacn

SEQ ID NO: 716 - DNA, 366 bp, Thellungiella halophila
  misc_feature (69)..(69): n is a, c, g, or t
  misc_feature (80)..(80): n is a, c, g, or t
  misc_feature (86)..(86): n is a, c, g, or t
tcaattcgattcacctgttaacgcaattcaagcgtatcttctccggcgtaatcatgacaacttcaaagnagactggcagnacaggnaagtatagagaagtttgacaagaacattactaagagaggttttgtgccagagaccaccaccaagaagggcaaggattaccctgtcggtcccatccttctcggcttctttatcttcgtcgtcattggatcttcgctcttccagatcatcaggaccgcaactagcgggggcatggcgtaaaccgaatccaattcaagctagaagatgcagttttcaaaatgaatatctcttcttcttacttgtctctttttctctccttcatactgtagaacgcgtcgactt

SEQ ID NO: 717 - DNA, 581 bp, Nicotiana tabacum
ggccattacggccggggaatgaataaaaagtcaaaataaattggggcagagaaaaggtggaagaagaaacccttagctgaatttttcgtgttctcatctatcagcggccaccggattttgcttcaactatgacgacatcgaggcgtcttgctgacaggaagattgagaggtttgagaaaaacattaccaagcgaggagctgttcctgaaactaccgcaaaaaagggaaaccagtatcctgttggccctatattgcttggtttctttgtctttgttgtcattggctcatctctgttccagataataaggaccgcaaccagcgggggcatggcttaagcatggaagttaaaagtggtggtgttataggctttgcctgcttgttgtagtagtgtttttctcaaagtttagcccaatgtagaaattgaagagaaacttcaatagaactgtttttaacttgtgagatactcggagaagtataaattttctcctgtctcgtgtgttgatatatttgtgtccattgcgttcttgcagaggtttaaatatcctttcacttctagtataaaccattattataaaatcctt

SEQ ID NO: 718 - DNA, 1408 bp, Raphanus sativus
gggccaaatatccattgagataaaaggatcaccgcttcttgtggttctcatctctcctcttctaaattactccaatctcgtagctaaggaaaatctgaaacctcgataaatctggaataagggaatgaaatgagtaagagagcgttgcccaaatcgccacctaaacttgttctattgccagctcttcttatcctttcctcaacatgtttgtttggcatcctcacaaaccttcaaaccttatcatatctcttccgtcctctctgggacaaaccaccaccaccattcagacgaatcccgcattactacgccgagaacgtctccatgtcacacctctgccacctccacggatggactccccgtacttctccaaggcgagtcttcgacgccatcatcttcagcaacgagctcgacctcctagaggtgagatggcaggagcttggaccctacgtttcaaaattcgtcattcttgaatccaacaccaccttcactggcatccccaagcctctcttyttcgactccgcgaaggcgagattcgccttcgcggagggtaagatagtccacggggtgttccctgggcagaagcgtagtagtttacaagaagaagatccattcttgctcgaaggccggcaacgggttgctatgaactggctcctcagagaagctaatgtctctgatggagacgcggtgataatgtccgatgcggatgagattcccagtcctcataccgtcaagctcctacagtggtgcgacgggataccsgacgtgatgcatctggagatgagggattacatgtactccttcgagttccctgttgattacagcagctggagagcgtccgtgcatttatacagcaggaaatggactcactaccgccactcccggcagaccgacttgatactgtctgacgccgggtggcattgtagcttctgtttcagacgtctcagcgagtttgtgttcaagatgaaagggtatagccatgcggatagagtgaggcgcaaggagtttcttgactactccaggatacagaaacgtatttgtaaagggtatgatctctttgacatgcttcctgaagaatacagcttcagagatttgattagcaaaatcggaccgatcccgccttctgcatctgctgtgcatctacctgcgtttttgattcagaatgccgcccgctttcgttttctcctaccaggaggctgtctcagagagcctttaagctaagtgaggataggaggatcttagtacaaaatagataagcaatggtttctgctgaaaaagaaaatagatcgttattacatcatgttaatgtgtttccattcatgtttagtatcaaactttttctgggcaccaccatcatcagtgtaccaatttatttcgagcaaaactgaatataacgcaatccccttaaaat

SEQ ID NO: 719 - DNA, 818 bp, Raphanus sativus
ctcgaaggccggcaacgggttgctatgaactggctcctcagagaagctaacgtctctgatggagacgcggtgataatgtccgatgcggatgagattcccagtcctcataccgtcaagctcctacagtggtgcgacgggatacccgacgtgatgcatctggagatgagagattacatgtactccttcgagttccctgttgattacagcagctggagagcgtccgtgcatttatacagcaggaaatggactcactaccgccactcccggcaaaccgacttgatactgtctgacgctgggtggcattgtagcttctgtttcagacgtctaagcgagtttgtgttcaagatgaaagggtatagccatgcggatagagtgaggcgcaaggagtttcttgactactccaggatacagaaacatatttgtaaaggatatgatctctttgacatgcttcctgaagaatacagcttcaaagatttgattagcaaaatcggacccatcccgccttctgcatytgctgtacatctacctgcgtttttgattcagaatgcgcctcgctttcggtttctcctaccaggaggctgtctcagagagccttaagctaagtgaggataggaggatcttagtacaaaatagataagcaatggtttctgctgaaaaagaaaatagatcgttattacatcatgttaatgtgtttccattaatgtttagtatcaaactttttctgggcaccaccaccatcatcagtataccaatttatttcgagcaaaattgagtttaacgcaatcaccttataataagagaaattagaattttgaaga

SEQ ID NO: 720 - DNA, 761 bp, Brassica oleracea
ggagaacaccagttgcatcagttttgtctgagagagcaccacttttgtgtcgatcttttctagcgatgtcgattcctcaggccaagatggagcttcgtcctctgggaaacacaggcctcaaagttagctcagttggcttcggcgcctctcctctcggaagcgtcttcggtccagtcgccgaagttgatgccgtcgccaccgtacgcgaagcgttccggcaaggcattaacttcttcgacacttccccgtattatggaggaacactatcggagaagatgcttggtaaaggactcaaggcactacaagtccctagaagcgactacattgttgcaaccaagtgtggacgttacgaagaaggtttcgacttcagcgctgagagagtaacgaagagcatcgacgagagcttggagaggcttcagctagactacgttgacatacttcactgccacgacattgagttcgggtctcttgaccagattgtgagtgaaacgatccctgcgctccagaaactgaaacgtgaagggaagacacggttcatcggtatcactggtcttccgttgagtattttcacttatgttcttgatcgagtgcctccagggacggttgatgtgmtactatcgtactgccattacggtgtgaatgattcgacgttggtggatttgataccttacttgaaggggaaaggtgtgggtgtgattagtgcttctccattggctatgggtctccttacggaacaaggtggtcctgaatggcatcctgct

SEQ ID NO: 721 - DNA, 1097 bp, Brassica rapa
ctgagaaccacttttgtgtcaatctttagcgatgtcgattcctcaggccaagatggagcttcgtcctctgggaaacacaggtctcaaagttagctccatcggctttggcgcctctcccctcggaagcgtcttcggtccagtcgccgaagtcgatgcagtcgccaccgtacgcgaggcgttccgacaaggcattaacttcttcgacacttccccgtattatggaggaacactgtcggagaagatgcttggcaagggactaaaagcactacaagtccctagaagcgactacattgttgcaaccaagtgtggacgttacgaggaaggctttgacttcagcgctgagagagtaacaaagagcatcgacgagagcttggagaggcttcagctagactacgttgacatacttcattgccacgacattgagttcgggtctcttgaccagattgtgagtgaaacaatccctgctctccagaaactgaaacaggaagggaagacacggttcatcggtatcactggtcttccgttgagtattttcacttacgttcttgatcgagtgcctccagggacggtcgatgtgatactatcgtactgccattacggtgtgaatgattcgacgttggtggatttgataccttacttgaaagggaaaggtgtgggtgtgattagtgcttctccattagcaatgggtctccttacggaacaaggtggtcctgaatggcatcctgcttcccctgagctcaagtctgcttgcaaagccgctgctgctcattgtaaatcaaaaggtaagaagatcacaaagttggcgttgcagtacagcttggcaaacaaggagatttcatcagtgttggttggaatgagctctgtctcacaggtagaagaaaatgttgcagcagttaaagagcttgaagatttgggtatggatcaagaaactctctctgaggttgaagctattcttgagcctgtcaagaatcagacatggccaagtggagtcgatcagaagtagaagctcttttgttgtgtttgttcacatttacttctaggggtgctttgatgtgtcgataaccagttttaagttgagttgatacgattataagctc

SEQ ID NO: 722 - DNA, 928 bp, Brassica napus
gtattctcttctcgaccatatctatctccccagttgcatcagttttgtctgagagagcaccacttttgtgtcgatcttttctagcgatgtcgattcctcaggccaagatggagcttcgtcctctgggaaacacaggcctcaaagttagctcagttggcttcggcgcctctccgctcggaagcgtcttcggtccagtcgccgaagttgatgccgtcgccaccgtacgcgaagcgttccgacaaggcattaacttcttcgacacttccccgtattatggaggaacactatcggagaagatgcttggtaaaggactcaaggcactacaagtccctagaagcgactacattgttgcaaccaagtgtggacgttacgaagaaggtttcgacttcagcgccgagagagtaacaaagagcatcgacgagagcttggagaggcttcagctagactacgttgacatacttcattgccacgacattgagttcgggtctcttgaccagattgtgagtgaaacgatccctgcgctccagaaactgaaacgtgaagggaagacacggttcatcggtatcactggtctcccgttggatattttcacttatgttcttgatcgagtgcctccagggacggtcgatgtgatactatcgtactgccattacggtgtgaatgattcgacgttggtggatttgataccttacttgaaagggaaaggtgtgggtgtgattagtgcttctccgttagcaatgggtcttcttacggaacaaggtggtcctgaatggcatcctgcttcccctgagctcaagtctgcttgcaaagccgctgctgctcattgtaaatcaaagggtaagaagatcacaaagttggcgttgcagtacagtttgggcaacaggagatttcatcagtgttggttggaatgagctctgtctcacaggta

SEQ ID NO: 723 - DNA, 1176 bp, Raphanus sativus
gggtattctcaagtctcaaccatatctatctcccagtttgcatcagtttcgtctgagagaaccacttttgcctcgatctttttagcgatgtcgattcctcaggcmaagatggagcttcgtcctctgggaaacacaggtctcaaagttagctccrtcggcttcggcgcctctcctctcggaagcgtcttcggtccagtcgccgaagtcgatgccgtcgccaccgtaagcgaggcgttccgacaaggcattaacttcttcgacacttccccgtattatggaggaacactatcggagaagatgcttggaaagggactaaaggcactacaagtccctagaagcgactacattgtggctaccaagtgtggacgttaccaagaaggctttgacttcagtgccgagagagtcacaaagagcatcgacgagagcttggagaggcttcagctagattacgtcgacattcttcattgccacgacattgagttcgggtctcttgaccagattgtgagtgaaacaatccctgcgctgcagaaactgaaacgggaagggaagacaaggtttatcggtatcaccggtcttccgttgagtattttcacttatgttcttgatcgagtgccyccagggagtgttgatgtgatattrtcgtactgccattacggtgtaaacgattccacgttgcttgatttgttgccttacttgaagagcaaaggcgtgggcgtgataagtgcttctccattggcaatgggtctccttacggaacaaggtcctcctgagtggcaccctgcttcccctgagctcaagtctgcttgcaaagctgctgctggtcattgtaaatcaaagggtaagaagatcacaaagttagcactgcagtacagcttaggaaacaaggaggtttcatcagtgttggttggaatgagctctgtctcacaggtggaagaaaatgttgcagcagttagagagcttgaaggtttgggtatggatcaagaaactctvtctgaggttgaagctattcttgagcctgtaaagaatcagacatggccaagyggaatcgatcaaaagtaaaaagctctcttcgttgtgtttgttcacattacttcttcttggaatgctttgatgtgtcggtaacagttttatgttgagttgatacggttaataaaattttttaggtaatatcaaaac

SEQ ID NO: 724 - DNA, 1089 bp, Raphanus sativus
tttttatcgatgtcgattcctcaggcaaagatggagcttcgtcctctgggaaacacaggtctcaaagttagctccatcggcttcggcgcctctcctctcggaagcgtcttcggtccagtcgccgaagtcgatgccgtcgccaccgtaagcgaggcgttccgacaaggcattaacttcttcgacacttccccgtattatggaggaacgctatcggagaagatgcttggtaagggactaaaggcactacaagtccctagaaatgactacattgtggctaccaagtgtggacgttacgaagaaggtttcgatttcagtgctgagagagtcacaaagagcatcgacgagagcttggagaggcttcagctagattacgtcgacatacttcactgccacgacattgagttcgggtctcttgaccagattgtgagtgaaacaatccctgcgctgcagaaactgaaacgggaagggaagacaaggtttatcggtatcactggtcttccgttgagtatattcacttatgttcttgatagagtgcctccagggagtgttgatgtgatattgtcgtactgccattacggtgtaaacgattcgacgttgctggatttgttgccttacttgaagagcaaaggtgtgggcgtgataagtgcttctccattggcaatgggtctccttacggaacaaggtcctcctgaatggcaccctgcttcccctgagcttaagtctgcttgcaaagctgctgttggtcattgtaaatcaaagggtaagaagatcacaaagttagcactgcagtacagcttaggaaacaaggaggtttcatcagtgttggttggaatgagctctgtctcacaggtggaagaaaatgttgcagcagttagagagcttgaaggtgtgggtatggatcaagaaactctctctgaggttgaagctattctcgagcctgtaaagaatcagacatggccaagtggaatcgatcaaaattaaaagctctcttcgttgtgtttgttcacattacttcttggaatgctttgatgtgtcggtaacagttttaagttttaagttgagttgatacggttaataaaatttcttagg

SEQ ID NO: 725 - DNA, 1482 bp, Arabidopsis thaliana
atgattgtttgttttttttgtggacagaagcaggtattgaagcaattggagccatggtgtgaacttaaagataaagtggttcttgtgacaggtgcttcctctggtatagggagagagatctgtcttgatctatgcaaagctggttgtaagattgtagcagcagctcgtcgtgttgatcgtctcaactctctctgttctgaaatcaacagctttggtgctatcggagtccaagccgtagcacttgagctagacgtttcatcagaagcagacactattcgaaaagcggttaaagaagcttgggaaacctttggaaagatcgatgttttgatcaataatgccggaatcagaggcaatgtcaagtcgagtttggatttgtcagaagaagaatgggacaaagtctttagaaccaacttaaccggatcttggttaatatccaaatacgtctgccttttgatgcgtgacgctgagcgcgggggctcggtgattaacgtctcgtcgatctctgggcttcatcgcggtttgttgcgcggtggactagcgtatgcttgttccaaaggtggtgttgacaccatgacgaggatgatggctattgagttagctgtttataagatcagagtgaactcgatcgcaccggggattttcaggtcagagatcacacaaggtcttttccagaaagagtggctcaagaaggttacggaaaaggttgtaccattaaagatgcaacagactgtggatccggggcttacatctcttgttcgctatctcattcacgattcttctcaatatgtcaccgggaatacatacattgtcgattccggaactacactgcccggtgtgcccattttttcttctctttctccgtagattcaattctccatttcccgcttccttcttccgccgccggagcaaccttcacaaccgccgtatcaaaccgaatcatctcctcgatcgcaaactccttagcgaaatcttgtaaatacgccaaaacttcaccatgactcggaaacctcctcggatctctagattccgatacaccggaacgaaccacgaacgggaagtccctgtatcccatacactcacgggggagattagttcggagagagccataaacgctcgaatgaacaacggatcgggtcgggtcaacgcttaatggatcgggttcgatatgatcggtgtatatccaggttcctccgacttgtttttgtctctcgaagacgaccaccgagtgaccttcccgtcgaagctctcgcgccgctactaatccggcggctccggcgccgataactgccacgtggtgtgatctgattggtgataaggaaggcgccattggtttttttaacgagattcgttaacgatggtgaatatactacggcctttttataaatatgtggcccaaaaactcatgatccacacacaccacgacacaatgttaaaaaaacaaaaacaaattcctgagaaattatctaaacgctgcgttttatc

SEQ ID NO: 726 - DNA, 1958 bp, Arabidopsis thaliana
aatgtccattacaaacaacaacagcatcataaatctcatcacgacgaactttcttctctttctccgtcgattcaatcctccacttcccgattccttcctccgccgccggagaaaccttcacaacctccgtctcaaacctaaccatctcctcaatcccaaactccttagcgaaatctttcaaatacgccaaaacttcgccatgactcggaaacctcctccgatctctagacacaccggaacgaaccacgaacgggaaatctctgtatccggtacactctcgtgtaccgttgattcgtagagatctatagacgcttgaatgaacaacggatcgggtcgggtcaacacttaacggatccgattcgacttcatcggtgtaaatccaggttcctcccacttgtttttgtttctcgaaaacgaccactgagtgaccttctcgtcgaagctctcgtgccgctactagtccggcgggtccagcaccgataaccgccacgtggtgtgatctgaagcaggtattgaagcaattggagccatggtgtgaacttaaagataaagtggttcttgtgacaggtgcttcctctggtatagggagagagatctgtcttgatctatgcaaagctggttgtaagattgtagcagcagctcgtcgtgttgatcgtctcaactctctctgttctgaaatcaacagctttggtgctatcggagtccaagccgtagcacttgagctagacgtttcatcagaagcagacactattcgaaaagcggttaaagaagcttgggaaacctttggaaagatcgatgttttgatcaataatgccggaatcagaggcaatgtcaagtcgagtttggatttgtcagaagaagaatgggacaaagtctttagaaccaacttaaccggatcttggttaatatccaaatacgtctgccttttgatgcgtgacgctgagcgcgggggctcggtgattaacgtctcgtcgatctctgggcttcatcgcggtttgttgcgcggtggactagcgtatgcttgttccaaaggtggtgttgacaccatgacgaggatgatggctattgagttagctgtttataagatcagagtgaactcgatcgcaccggggattttcaggtcagagatcacacaaggtcttttccagaaagagtggctcaagaaggttacggaaaaggttgtaccattaaagatgcaacagactgtggatccggggcttacatctcttgttcgctatctcattcacgattcttctcaatatgtcaccgggaatacatacattgtcgattccggaactacactgcccggtgtgcccattttttcttctctttctccgtagattcaattctccatttcccgcttccttcttccgccgccggagcaaccttcacaaccgccgtatcaaaccgaatcatctcctcgatcgcaaactccttagcgaaatcttgtaaatacgccaaaacttcaccatgactcggaaacctcctcggatctctagattccgatacaccggaacgaaccacgaacgggaagtccctgtatcccatacactcacgggggagattagttcggagagagccataaacgctcgaatgaacaacggatcgggtcgggtcaacgcttaatggatcgggttcgatatgatcggtgtatatccaggttcctccgacttgtttttgtctctcgaagacgaccaccgagtgaccttcccgtcgaagctctcgcgccgctactaatccggcggctccggcgccgataactgccacgtggtgtgatctgattggtgataaggaaggcgccattggtttttttaacgagattcgttaacgatggtgaatatactacggcctttttataaatatgtggcccaaaaactcatgatccacacacaccacgacacaatgttaaaaaaacaaaaacaaattcctgagaaattatctaaacgctgcgttttatc

SEQ ID NO: 727 - DNA, 722 bp, Brassica rapa
catgcgatctagtgacgaagcaagcactgactttggtgcaaacatactcatgcaggtgccacttgtcaggaacatgtcggtgctgactgtggagaggcaaccgtgggacggtgacaaccagtttggtataccgtatccctcgtattttcacccgtacacgtcagcagagatgttgacgtggcaagacaagatgagaagggttgagagaccacatttgtttagttttgtcggtggtccgagaaagggcttggagaaagcagccattagagacgagctgatcagacaatgcgctgactcaagccgttgtgagcttctcaagtgtgaaagtggagggtccaggtgccacgacccgatgacggtattaggagtgatggctcggtcacggttttgcctacaagcaccaggtgactcgttcacacgtaggtcaacattcgatgcaatgttagccgggtgcataccggtgtttttttcaccacacactatgtatacacaatacatgtggtatcttcctgacgacaaaaggagttactcagtgtttatggacgaaaagaacagtactctaatagaacaagaactctcgaggatctcggagagtgacgtggttcaaatgagggaagctgttattgcaatgatcccgaaaatgacttatgcgcacccaaacgctactaactataatttgccaggggcggttgatgtagcgttagaggcattagctatgcaag

SEQ ID NO: 728 - DNA, 857 bp, Brassica napus
tctagtgacgaagcaagcactgactttggtgcaaacatactcatgcaggtgccacttgtcaggaacatgtcggtgctgactgtggagaggcaaccgtgggacggtgacaaccagtttggtataccgtatccctcgtattttcacccgtacacgtcagcagagatgttgacgtggcaagacaagatgagaagtgttgagagaccacatttgtttagttttgtcggttgtccgagaaagggcttggagaaagcagccattagagacgagctgatcagacaatgcgctgactcaagccgttgtgagcttctcaagtgtgaaagtggagggtccaggtgccacgacccgatgacggtattaggagtgatggctcggtcacggttttgcctacaagcaccaggtgattcgttcacacgtaggtcaacattcgatgcaatgttagccgggtgcataccggtgtttttttcaccacacactatgtatacacaatacatgtggtatcttcctgacgacaaaaggagttactcagtgtttatggacgaaaagaacagtactctaatagaacaagaactctcgaggatctcggagagtgaggtggttcacatgagggaagctgttattgcaatgatcccgaaaatgacttatgcgcacccaaacgctactaactatgatttgccagatgcggttgatgtagcgttagaggcattagctatgcaagcaaagacaaaggttgtgtactcattgtaataagctcttatgtttttgctcctttttggatgtaatttaatcatactcttaatcatattgactcgagaattgccgaatactgagaatgaacatgggcatgttgctaggggggc

SEQ ID NO: 729 - DNA, 2080 bp, Brassica napus
ggcatcatcacctctcttttcttcttcatccctttttcgtcttcttctagttttgtctttggttaaagcttaaaaatggatgtagtgaagattgattacaactacaagggtgacaatgcattaaaagagctcgagaggatcacctcgaaggctgctgaagttcaagataacattttatgtggratcctggaacaaaacaaggacacacagtacttgagcaagtacatgaaaggctctaaggacgttctggagtttaaacgctctgtgccartcatcacgtacaargatgtmtgtccttacattcagagaattgcaaatggagaagactcttctctkattactggtcatcytatcactgagatactatgcagctcaggaacttctggtggagagccgaagctaatgccaaccatttcggaagatcttgatcggcgcacctttgtctacaatcttatcaatccaatcgcgaacaagtatctagaaggacttgacaaaggaaaaacaatgtacctaaacttcgtcaaagctgaaacatcaactccttgtggtttaccaatcagaactgtcctcactagctactacaagagcaaacatttccagtgccgaccttacgatccattcaacgacttaaccagtcccatccaaaccatcctttgtgaagacagcaaccaaagcatgtactgtcagttacttgccgctcttattcaccgtcacaaagtcatgcgtctcggagctgtcttygcytcwgcstttctccgtgcaatctcttatctcgagcgaaaatggagccagctctgccaagacatccgcaccggccatctcagtcccatgatcaccgatccaggatgccagacggcgatgtcttctcttttagcgtcgccaaatcctgacttagctgacgagattgaagaaatctgtggacgcccgtcgtggaaagggattctgtgtcagctctggcctcaagcaaagttcattgaagcagtagtgacagggtcaatggctcagtacataccagcgcttgagttctttagccaaggcaagattccgttggtttgtccaatgtatgcttcctccgagacttactttggagtcaacgtgatgccactctccaagccatctgacgtcgttttcacgctcttgcccaacatgtgctacttcgagttcattcctctcggcaaaaacggaactctctcttttgacgtagaggacgaagaagtcgtcccctgtgacaaagtggttgacttggtcgacgtcaaactcggacgttactatgaactcgtcgtcacaaccttcgcaggattgtaccgttacagaatcggcgatgtccttcaagtggcggggttctacaacaaagcaccacagttcaagtttatctgcaggagaaacgtggttctaagcatcgacttagacaaaaccaacgaggaagatcttcacaggagcatcacgctggccaagaagaagcttgaaaacaaggcattcctcgcggagtacacgagctacgcggatacttcatcagtgccaggtcactacgtgctcttctgggagatccaatggctcgaacctgatgatgaggaggagaagctgctgatggaagagtgctgcattgcggttgaggaagagctggattacatatacaggcaatgcagaaagagagatagatcggtggggcctttagagataagagtggtgaaggcagggacgttcgagaagctgatggatatgataataagccaaggagggtcgcttaatcagtacaaaacgccgagatgtgttaagtccaacagtgctatgctcaagctcttggacggccacgttaccggttccttctttagccctcgtgatccaacctggtccccttgatgtcgaacgtatgtattgatcggagagactatatagtttactaatcagtattcggtaatataaatgggatcggatttgctgtaatgctagcagtagcaggcatgtaatgctactacctgattgataaaaaaaatgttataagaaacttcatttaccgagttatctatatcttatagttcctttcagtttctcgtcacataatataactttatttaccgag

SEQ ID NO: 730 - DNA, 1251 bp, Brassica napus
gaagggtttaataatgaggtcttgaggaaaggttgtgaagaactagggttaaaagtgaagaatattccgaggaatgcttcaaaggatcattactgtgggttttgttccttgagatgcaagaaaggtcaaatgcaggggacttcagagacttggcttgtagatttagtggaatctggtaatggtttgatccttccaggttgtagagcgatggaagtcttgtacgagtgtgaaagtgggaacaagaagaagacctctactggaattgcgtttgcgtttggggaagacatctatgtggtggagtctagggccacggtagtggcctgcggtgcgcttagaacgcctcatttgttgaaacgcagcggtttgaagaatggtaacattgggagaaacctttgtttacatccagttgttatggcttggggatggttccctgaggaggagaagtggcctgagaagaagaaaaagagctacgagggagggataatgacagcaatgtctagcgttgtwaacgcagaagcaaagactacttatggtgaaacggtgatccaaacgccttctcttcatccagggatgttctcaggggtcattccttggacgtcaagcaatgatttcaaaacccgaatgctcaaattctcaagaaccgcacacgttttcacgcttttgagagataaaggaactggaacaatcaattcgaagagttacattgactacaacttaaacgatgaagacgaagagagtctaaagaaaggtcttgggagtgtcttgaacattttgatagcggctggagctgaggagatcgggacgcataactcagaaggtaagagtttgaacgttagaacagcgagtgcggtagagattaagaggtttgtgagagaagagagttcaaagagcttgaaggatttgtctggacagatatgttcagctcatcaaatgggaagttgtaggatgggaatcagacctgaagaatctgcggtgaagccaacgggagagacttgggaggtcgaaggcctrtttgtggcggacacaagtgtttttccgacggctttaggggttaatccgatggtcaccgttcagtcaattgcttattgtattggacttaatgttgttggggctcttaagaagaagtgaagtctcgtttatactagacttaagttttcatattggaaaaataatatgctttcttaataattttttaataaacttttgtttttattararwrmmrtttaaatccggaaaagtttattgctgac

SEQ ID NO: 731 - DNA, 720 bp, Brassica oleracea
ggcttcactcactatcactaaaacaaagaacagaaatgggaacttcagtaataaaagctctcaaatatcttctacttttcaacatctcattgaccttcatctacaccaatgaagtctccgcttctccagtgactctaccggcggcaaagatgagccgtagacctgtagcggttcaaggcatggtttattgcaagtcttgcaagtactccggcattaatacgctcctagaagcatctcctcttcaaggagcgactgtaaagcttgcatgcaacaacacaaagagaggtgtgacgatggagacaaagacggacaaaaacggatactttttcatgttagctccgaataaactcaccacctacgcttttcacacatgccgggcttggcccacgaacccaggtcccgcggctgctacggtaacatgcaccgtcccttcacagctcaataatggaaccaccggtgctatgcttaagccttctaaatcaatcaacatagctgaacgcggctacgttttattctctgttggtcccttcgcgtttgaaccggcatgtactcgttgaagtctcgactttcttctttatgtatgtgtgtgcttgcttgttatgactatctatcactagtgctttaaatgttttcatcgtcgtgtttgcttttttagtatgttcacgttttaaagcttgtcttggtacacattttgagattgttggtgtgaaaaaaaaaaaa

SEQ ID NO: 732 - DNA, 748 bp, Brassica napus
aggggactcactatcactaaaacaaagaacagaaatgggaacttcagtaataaaagctctcaaatatcttctacttttcaacatctccttgaccttcatctacaccaatgaagtctccgcttctccagtgactctaccggcggcaaagatgagccgtagacttgtggcggttcaaggcatggtttattgcaagtcttgcaagtactccggcattaatacgctcctagaagcatctcctcttcaaggagcgactgtaaagtttgcatgcaacaacacaaagagaggtgtgacgatggagacaaagacggacaaaaacggatactttttcatgttagctccgaataaactcaccacctacggtttccacacatgccgggcttggcccacgaacccaggtcccgcggctgctacggtgacatgcaccgtcccttcacagctcaataatggaaccaccggtgctatgcttaagccttctaaatcaatcaacatagctgaacgcggctacgttttattctctgttggtcccttcgcgtttgaaccggcatgtactcgttgaagtctcgactttcttctttatgtatgtgtgtgcttgcttgttatgactatccatcactagtgctttaaatgttttcatcgtcgtgtttgcttttttagtatgttcacgttttaaagctcgtcttggtagacattttgagattgttggtgtgtttgatttcctatatatccttattgcttttctcttcttcac

SEQ ID NO: 733 - DNA, 2562 bp, Arabidopsis thaliana
tttccaactgtctttacacagaaaaggttaacaaaaacggtcagaaaaaaaaagactaccgacaaaaaaaaagacagttcatttttttgttatattgatctttcgattatcttttgcacattcttgtcctgatcttcttcttctttcttcccagtttctctcttcgagcttccggaatctttggtgatcaccgaccggatctggacgaagaatctcgttaacaaactcaacaagcattctccaaagcttcctcctttttcttcaacgatcgtcattgcattgtaatttggagagtttagctacaaagtctgtcttcatcgaattaagatctatctgatttttctgggtggttctcatgtgtgagatttttgatgggtttagagttgtcggatatggaaggttcttcttatctttgatttgttttatatattaagcggcagaatttgaggttgacttgagcgagaatctggattctttcgaggagtatttaatgttcctgagaattccctgtttttgcgtcaagttttcatttttctgagtgttaataaatttagaatcattagtgcagcagatagagagagagtgtgtaaatctgaggaagactctctgtggatttgattcgtctttgtgagtcaggaatctgtttgatgaaattcccctgtggagagttttaggattttagaaaatgtgtaaagcggagaagtttctttatcacaggaaactctgggagatgaaggttaagtttctaggagatagtaagattgacaagcttaagaactccttggttttgaggtctcgtatgagcttatggatgattcgtgctatgactatattgttgctatggagttgctttgttcatttggttgctgtgggagagatgtggggacctagattgttgaaaggctggccttcttgtttcaatcaccatgacttccccattgctgcagaaatgacttctcttcccatgaaaatcgccctcccacctaaaaggatatatcagaacaatggctatcttatggtttcttgcaatggaggactcaaccaaatgcgagcagcgatatgtgatatggtcactattgcaagatacatgaatgtcacacttattgtcccagagcttgacaagacctcgttttggaatgatccaagtgagttcaaagacatattcgacgtggaccatttcataagttctttaagggacgaggttcgtatactaaaagagcttcctccaaggcttaagagaagggttaggctcgggctgtaccacaccatgcctcctattagctggtccaacatgtcctactaccaagaccagattcttccgctggtgaagaagtataaggtggtacatctgaacaagaccgatactcgacttgctaataacgaactacctgttgagattcagaagctgcgatgccgagcaaatttcaatgggcttaggtttactccaaagattgaggaattgggtagaagagtagtcaagattctcagggagaaaggtccctttctagttctgcatctcagatacgaaatggatatgttggcattttctggttgctcacatggttgcaaccgctacgaagaggaagaactaacaagaatgagatatgcttatccgtggtggaaagagaaagtaatagactccgagttgaagaggaaagaaggtctttgcccattgactcctgaagaaacagctcttacgctatctgcattgggtattgaccgaaatgttcagatttacatagctgcaggagaaatatacggtggtaaaaggcggttaaaggctttaacagatgtttttccaaatgtggtgaggaaagaaactctactcgattcttctgatttgagtttttgtaaaaaccattcttctcaaatggctgctcttgattaccttatctctctcgaaagtgatatattcgttcctacttattacggaaacatggcgaaagtcgtggaaggtcatcgcaggttcttggggttcaagaagacaattgagctaaaccggaagttgttggttaagctgatagatgaatattatgaaggattgttgagctgggaagtgttttcaaccacggttaaggcctttcacgctacacgaatgggagggccaaagagacggctagtgattccaaataaaccgaaagaagaagactacttctatgctaatccatatgaatgtcttcagctattacatgagaataatggcaattcactagaagaaacctaatgaacagatcctccaatgttgtctttcgtgggggtgatgcaggacatggatggagttatctaatgggaatgatatatccatctggaagattaggtttcttaaagagatgagaagttatttagggttctttggtgtacagagatatctgaagagcttcagttgatgcagaagaaaggttgaagctttcagggtcatgtttgcaaatttgtcctatgccacctcagtcatcatcatccatggccttgcagttttggtagctaaaaagtaaaatgcagtgtaaaattatatcacacatatgattatcattattattattttacaaaataaataattattct

SEQ ID NO: 734 - DNA, 1531 bp, Brassica rapa
gcacgaggctcccttccgcctaaaagggtatatcagaacaatggttatcttatggtttcatgtaatggaggactcaatcaaatgcgagcagctatatgcgatatggtaactgttgcaagattcatgaatgtcacacttattgtgcctgagcttgacaagacctctttttggaacgatccaagtgagtttaaagacatattcgatgtggatcacttcataacttcgttaagagatgaagttcgtatactwaaagagttgcctccaaggstyaagaaragagttgagcttggaatgyaccacgaaatgcctcctattagttggtcaaacatgtcttactaccaaaaccagattcttccactggtraagaagcataaggtsytrcayctkaacaaaacmgactcmmgrctcgctaataatggactgcctgtggaggtccagaagctgaggtgcagagtgaatttcaacgggcttaagtttactcctcaaattgaagaattaggtagacgggtagtcaatattctgagagagaaaggtccctttctcgtcctgcatctcagatacgagatggatatgttagcattttccggttgctcacatggttgcaaccctgaggaagaagaagaactaacaagaatgagatatgcttatccatggtggaaagagaaagtcataaactctgaggtgaagaggaaagaaggcctttgtccgttaactcctgaggaaactgctctcacgctgactgcgttaggcattgaccgtaacgttcaactttacatagctgctggtgaaatctacggtggtgagaggcggatgaaggctttaacagacgcttttccaaatgtggtccggaaagaaaccatactagaatcttctgatcttgatttttgccggaaccattcatctcaaatggctgcactggattacctagttgctgttgagagcgatatatttgttccaaccaatgatgggaacatggcaagagtcgttgaaggtcatcgcaggttcttgggatttaagaagacaattcagctgaataggaagtttctagttaagctgatagatgaatacaccgaaggattgttgacttgggatgtgttctcatccatggtgaaggcctttcactctactcgaatgggaagtccgaagagacggttattgattccgaataaacccaaggaagaagactacttctactccaacccgcaagaatgtctgcagctgttagatgaaccactgagagtcatttgattattggcggaagaaaatatttacagtctttgagatgggagttacagtgagttttttcttttatttacaggcttgagttacttagagttcttggtgaatagatttctgtatgagcttccatggatggagaaaaaaaatgatgttgattgaagcttacgttgtaaagtttggcatccatggccttgccagttttgttagctaaataaaaagtgccattttatgtaattaaaccttggttatacactatatttcagattaatatttcccctcttcagttagtatt

SEQ ID NO: 735 - DNA, 1460 bp, Brassica rapa
agagcttgacagacctctttttggaatgatcctagtgagttcaaagacatattcgatgtggatcacttcataacttctttgagagatgaggttcgtatactcaaagaggttcctccaagacttaagagaagggttgagcttggcgtttaccacaccatgcctcctatcagctggtccaacatgtcctactaccaagaccagattcttccactggtgaagaagcataaggtcttacatctaaacaagaccgacactcgacttgccaataacgaacttcctgttgaggttcagaagctgagatgccgagtaaacttcaacgggcttaggttcactccaaagattgaggagctaggtagaagagtggtcaagatcctgagggagaaaggtccctttctcgttctccatctcagatacgaaatggacatgctggcattctctggttgctcacatggttgcaaccgctacgaagaggaagaactcacaagaatgagatatgcttatccatggtggaaggagaaagtgataaactcagagttgaagaggaaagaaggtctttgcccattaactccagaagaaacagctctgacgctgtctgccttggggattgaccgtaatgttcagatttacatagctgccggagagatatacggtggtaaaaggcggttaaaggctttaacagacgtctttcccaatgtggtgaggaaagaaactctgctggattcctctgatttgagtttttgtaagaaccactcttctcaaatggctgctcttgattaccttatctctctggaaagtgatatattcgttcctacttattatgggaacatggccaaagttgtggaaggtcatcgcaggttcttggggttcaagaagacgattgagctaaacaggaagttcttggtcaatcttatagatgaatactaccaaggattagtgagctgggaagtgttcacgaccagggtgaaggcctttcacgctacaagaatgggaggtccaaagaagaggcttgtgataccaaataaaccaaaagaagaagactacttctatgctaatccttatgaatgtctccagctattacatgagaatgatagtggcaattcactagatgaaaccatatgatcagagccaccaccattgtcctacatttagatttggcaggacatggatgggtggataatggagtttatctatggggattatatcaatcttgaggatgagattcttaaagaggttatgtagggttctttggtgtacagagacatctgaagagcttctgtggatgtagaaggaaggctctgaagttttcattgtaaagtttgcagacttgtcattttggcaccatcacctcctcatccatggacctgcagttttgtagctgaaaaataaacaatgcagtgtataattatgttacacattattagttatttgattaaataaataagtgttctgtktcttatcca

SEQ ID NO: 736 - DNA, 1601 bp, Brassica rapa
gcacgaggctcccttccgcctaaaagggtatatcagaacaatggttatcttatggtttcatgtaatggaggactcaatcaaatgcgagcagctatatgcgatatggtaactgttgcaagattcatgaatgtcacacttattgtgcctgagcttgacaagacctctttttggaacgatccaagtgagtttaaagacatattcgatgtggatcacttcataacttcgttaagagatgaagttcgtatactwaaagagttgcctccaaggstyaagaaragagttgagcttggaatgyaccacgaaatgcctcctattagttggtcaaacatgtcttactaccaaaaccagattcttccactggtraagaagcataaggtsytrcayctkaacaaaacmgactcmmgrctcgctaataatggactgcctgtggaggtccagaagctgaggtgcagagtgaatttcaacgggcttaagtttactcctcaaattgaagaattaggtagacgggtagtcaatattctgagagagaaaggtccctttctcgtcctgcatctcagatacgagatggatatgttagcattttccggttgctcacatggttgcaaccctgaggaagaagaagaactaacaagaatgagatatgcttatccatggtggaaagagaaagtcataaactctgaggtgaagaggaaagaaggcctttgtccgttaactcctgaggaaactgctctcacgctgactgcgttaggcattgaccgtaacgttcaactttacatagctgctggtgaaatctacggtggtgagaggcggatgaaggctttaacagacgcttttccaaatgtggtccggaaagaaaccatactagaatcttctgatcttgatttttgccggaaccattcatctcaaatggctgcactggattacctagttgctgttgagagcgatatatttgttccaaccaatgatgggaacatggcaagagtcgttgaaggtcatcgcaggtgaaatgccgtcatctttcttcttcttctttcttcccatggcaagaggctaacaccagtttttctacaggttcttgggatttaagaagacaattcagctgaataggaagtttctagttaagctgatagatgaatacaccgaaggattgttgacttgggatgtgttctcatccatggtgaaggcctttcactctactcgaatgggaagtccgaagagacggttattgattccgaataaacccaaggaagaagactacttctactccaacccgcaagaatgtctgcagctgttagatgaaccactgagagtcatttgattattggcggaagaaaatatttacagtctttgagatgggagttacagtgagttttttcttttatttacaggcttgagttacttagagttcttggtgaatagatttctgtatgagcttccatggatggagaaaaaaaatgatgttgattgaagcttacgttgtaaagtttggcatccatggccttgccagttttgttagctaaataaaaagtgccattttatgtaattaaaccttggttatacactatatttcagattaatatttcccctcttcagttagtatt

SEQ ID NO: 737 - DNA, 1589 bp, Raphanus sativus
gatggtttcttgcaatggaggactcaaccaaatgcgagctgctatatgtgatatggtcactattgcaagatacatgaatgtcacacttattgtaccagagcttgacaagacctctttttggaatgatcctagtgagttcaaagacatattcgatgtggatcacttcatcacttctctaagggatgaggttcgtatactcaaagaggttcctccacggcttaagagaagggttgagcttggcgtgtaccacactatgcctcctatcagctggtccaacatgtcctactaccaggaccagattcttcccctggtgaagaagcacaaggtcttacatccgaacaagaccgatactcgacttgccaataacgaacttcctgttgaggttcagaagctgagatgcagagtaaacttcaacgggctcagattcactccaaagattgaggaactaggtagaagagtagtcaagattctgagggagaaaggtccctttctggtcctccacctcagatacgaaatggacatgctggcattctctggttgctcccatggttgtaaccgctacgaagaggaagaactcacaagaatgagrtatgcttatccatggtggaaggagaaagtaataaactcagagttgaagaggaaagaaggtctttgcccattgactccagaagaaacagctctgacacyatctgccttggggattgaccgtaatgttcagatttacatagctgccggagagatwtacggtggtaaaaggaggttaaaggctttaacagacgtctttccaaatgtggtcaggaaagaaactctgctggattcatctgatttgagtttttgtaagaaccattcttctcaaatggctgctcttgactaccttatctcgctagagagtgatatattcgttcctacttattatgggaacatggccaaagtcgtggaaggtcatcgcaggttcttggggttcaagaagacgattgagctgaacaggaagttcttggttaatctaatagatgaatactatgaaggactgttgagctgggaagtgttttcgaccagggtgaaggcctttcacgctacaagaatgggaggtcccaagaagcggcttgtgattccaaataaaccgaaagaagaagactacttctatgcgaatccatatgaatgtcttcagctgttacatgagaatgataatggcgattcattagatgaaaccatatgatcagagccaccaccattgttctacatttagatttggcaggacatgaatgtgtgaataatggagtttatgaggattattatatcaatcttgaggatgtgatttttaatgaggttatgtagggttcttttggtgtacagagacatctgaagagagcctcccttgatgtagaagaaaagttgcagttttcattttaaagtttgcagatttgtcatttggcaccatcaccatcgtcctcacccatggacttgcagttttgtagctgaaaaataaaaaaaaaatgcagtgcataattatgttacacattatcctcctgtatattaattgataattgataattttgtttatgtgtaagtttcatgaagttcaaaaaaaa

SEQ ID NO: 738 - DNA, 1205 bp, Brassica rapa
gttatagaaaacaagtgaacaaacacacaagaagacgtttcgacccatcaaagaggtaccaaaccaaataacccacacaataacacaagagaagcttgagatcttcaaatcaatggagaattgggcacaagaaaacttactgtcttacctcaaacccgtcgaaacttcatggcaaccacaagaccttttgcctcagaccaatgacgaagaccaattctacgagcaagtgaaagagctaagagatcgaacaagagagattcccgacgattactttgtagttcttgtcggagatatgatcaccgaagaagcattgccaacttatcaaacgactttgaatacactcgacggtgtcaaggatgagaccggcgggagtttgacgccgtgggcggtttgggttagagcgtggacggcagaggaaaaccgacacggtgatttgttgaataagtatctctatctatctggtcgtgttgatatgcaacatgttgaaagaactattcaatatctgatcggatctggcatggactcaaaatttgaaaacaacccttacaatggcttcatttacacgtctttccaagagagagcgactttcatctcccacgccaacacggcgaagctagccactacctacggcgacaccactctcgccaagatctgcggcacaatcgcagctgacgagaagcggcacgagacagcttacacacggatcgtcgagaagctcttcgagatcgatcctgatgggaccgtacaggctctagcgagcatgatgaggaagcgaatcacgatgccggctcatctgatgcacgatggtcgcgacgacaatctgttcgaccattacggtgcggtggcgcaacgaataggagtttatacggcgatggattacgccgggatattggagtttttgctgaggcggtggaaggtggagagcttaggagtgggtttgaccggcgaaggaaggagagcacaggagtatctgtgtagcctgccgcagaggatcacgaggttagaggaaagggctaacgatagagtgaaacttgggtcgaggccttctgttgccttcagctggatctacgggagagaagtcggattataagagacagttagctagagagtgttgtgttagtgaagttatgttaagagtggcatgtttgtaataaaatgtaaccataataaacgaacttaatgaagaaaaatgtttgataattgac

SEQ ID NO: 739 - DNA, 1364 bp, Brassica napus
gcaagcacgagagagagagagagagagagagagagagaaagaaagaatcaaaaagatctgttgaggagagagatagaaagaaagagagcggagatgtcgatagctttgcttttgccctcgccggtgatgacgcagaagccgtcgtcaataacttctcctccccgtggctttggatcttcttcttctcgtctccttcaagtttcttgcgtcaccaagaacccttctaggaataataacgtaacatgcaataattttcgaccaatcaaggaagtaaataaccaaataacacacacaataccacaagagaagctcgagatcttcaaatcaatggagaactgggcagaaaccacactactaccgtatctcaaaccggtcgaagattcatggcaaccacaggactttttaccggcgcccgagaccgatgatgcattctacgaccaagtcagagagattagagaacgaacaagggagattcctgatgactactttgtagttcttgtcggagacatgatcacggaagaagcacttccaacttatcaaacgacgttaaacacacttgacggcgttaaggatgaaaccggtgggagtttatcgccgtgggcggtttggatcagagcatggacggcggaggaaaaccgtcacggtgatttgcttaacaagtatctttacctatgtggtcgcgttgatatgcgacatgttgaaaggactatacaatatctaatcggttctggcatggactcgaagtttgaaaacaacccttacaatggattcatctacacatcgttccaagaacgcgccacattcatctctcrcggcaacacggcgaggctagccacgacctacggcgatacaacactagcaaagatctgcggcacaatcgccgcagacgagaaacgtcacgagactgcttacaccaagatagtggagaagctattcgagctagaccccgacggaacagtacaggcgctggcgagcatgatgaaaaagcggataacgatgccggctcacctcatgcacgacgggagagacgatcaactttttgatcactacgccgcggtggcgcagaggatcggagtttacacggcggcggattacgctggtatcttggagtttctgttgaggaggtggaaggtggagagtttggggtcggggttgtcaggtgaaggaaggagagcacaggagtatctgtgcaccttgccgcagagaatcaagaggttagaggaaagagccaacgacagggtcaaacgtcagtcaaagggttctgtctcgtttagctgggtgtttggtagagatgtggaattataaataaatttaacaataaatttaaccagtcaaataaataaatvatgtttgwtkktkrtsat

SEQ ID NO: 740 - DNA, 835 bp, Arabidopsis thaliana
cacacacatataaaagtctttgaaaagcattagcatatccctttgtttcaaaatgagggtttccaagtctctcatcctgattaccttatcggctttggtcatttcctttgctgaagcttatgatccaagtccacttcaagatttctgtgtggccattgatgacctcaaaaatggtgtttttgtgaatggaaagttctgtaaggatcccaagcaagcgaaggcagaataattcttcttctcaggcctcaaccaggcaggaagcactaataataaagtcagatccaacgtgacaacagtcaatgtcgaccagattccagggttaaacactatgggaatatccttggtccgcatagactatgcaccatatggacaaaacccgcctcacacgcaccctcgtgctactgagatccttgtccttatcgagggaacgttatatgttggttttgtctcttccaatcaagacaataaccgtctattcgccaaagttctgtacccgggtgacgtgtttgtgtttcccataggaatgatccattttcaagtgaatatcgggaaaacgcctgcggtggccttcgctggattgagtagtcagaatgctggtgttatcacgatcgctgatactgtgtttgggtcaacgcctccgattaatccagatattttagctcaagcatttcaattagatgtcaatattgtcgaggatcttgaggccaagtttagaaactaaatctagtcaccacaatacgagtgtttatggttgtaacacttaagtaatgatgtaacaagagttaaagatttatgctcaatataataaagaaaggtgttgttcacctaatttgat

SEQ ID NO: 741 - DNA, 696 bp, Brassica napus
ggacacgtaaacgaatctagagagagcattcacatatagccttttatttgaaaaatgaggttttttaaggctctcatcctcattcctattgccatattggctttggtaatttcctttgctgaagcttatgatccaagtccactccaagatttctgtgtcgccattgatgacctaaatggtgtttttgtgaatggtaggttctgtaaagacccgatgcgagtcaatgcagaagattttttcttctctggcctcaacgtgcctgggaacaccagtaatcaagttggctccaatgtgaccacggttaatgttgatcagatcccagggctaaacaccatgggcatatcattggtgcgcatagactacgctccacatggacaaaacccacctcacacgcatccccgtggctcagagatccttgtccttatcaaaggaacattatacgtcgggtttgtttcttccaatcaagacaataaccgtttattcgccaaagtattgcatcctggcgacgtatttgtgttccccattggaatgattcattttcaggtaaatattgggaaagtccctgccgttgcttttgcaggattgagtagtcagaatgctggtgtaatcacaatcgcaaacgctgtgttcggatcaaatcctcctatatatccagaagttctagccagggcgttccagttggatgaaaacattgtc

SEQ ID NO: 742 - DNA, 814 bp, Raphanus sativus
aaacgaatctagagagagcattcacataaccttttatctaaaaatgaggttttcttatgctctcatccctattgccatattggctttggtaatttcctttgctgaagcttatgatccaagtccactacaagacttctgtgtcgccattgatgacctatatggcgtttttgtgaatggtaggttctgtaaagacccgatgcgagttaatgcagaagattttttcttctcagacctcaacgtgcctgggaacaccactaatcaagttgggtccaatgtgaccacggttaatgttgatcagatcccagggctaaacaccatgggcatatcattggtgcgcatagactacgctccatatggacaaaacccgcctcacacgcatccccgtgggtcggagatccttgtcctcatcacaggaaaattatacgtcgggtttgtctcttccaatcaagacaataaccgtttattcgccaaagtattgcatcctggcgacgtatttgtgttccccattggaatgattcattttcaggtaaatattgggaaagtcccggccgttgcttttgcaggattgagtagtcagaacgctggtgtaatcacaatcgcaaatgctgtgttcgggtcaaaccctcctatatatccaaaagttctagccagggcgttccagttggatgcaaatattgttaaagaacttcasgctaagtttggtccatgaaacttytaagtcattggagtgcttatcattgctatatttatgcacttaaacaatgatgtaaaactaaatgttatgtcatataaactaaataaataatgttgtctt

SEQ ID NO: 743 - DNA, 561 bp, Brassica oleracea
ggccacaaacctcaaagtcgtgacattgaagaaggatatggaacgtggaggcttccatggctaccgcaagttctccctcaacaccaccaatccttctgaaccagcgaggtttttgatggcggaggggagcatgcagctagcagagcccaaccagactaacaaaaccgctaatggaggtgaagaggagtgcacggtgagggagcaagacaggttcatgcctattgccaacgtgatacggatcatgcggaggatcttacctgctcacgccaagatctcagacgactccaaggagacgatccaagagtgtgtctcggagtacatcagcttcataacaggggaggccaatgagcgctgccagagggagcagcgcaagaccatcactgccgaggatgtcttgtgggccatgagcaagctcggttttgatgattacatagaacctctcacgttgtacctccaccgctacagagagttggagggtgacagaggagttggctacaacgctggttccgttggcatgaccagtggcatggtggtcaagaggcctaatggtaccatgggaga

SEQ ID NO: 744 - DNA, 1191 bp, Brassica rapa
gtacctgaaggcttcccagcaagtgttaatgagtcctatgttccttacatgacctttcgagctttgaagcatttctttggtggagcgatgggtgtgtttaccactcaaacccttctcaattcagttggagccccacggaacagttctgcttctgctgctgttgcaattaattggattctcaaggatggtgctgggcgtgttgggaaaatgctttttgcgcgtcagggaaagaaattcgattatgatttgaaacagttacggtttgctggtgatcttttgatggagctgggtgctgctgtggagttaggaactgctgccgttccgcacctttttcttcctctagcttgtgctgctaatgttgttaagaatgttgcagcagtaacatcaacgtctactcgtacccccatctataaagcctttgctaaaggagagaacataggagacgtcactgctaagggagagtgtgttggtaatattgcagatctgatgggaactgggtttagtatattgatatccaaaagaaatccttcgttggttacaacctttggtcttctgtcatgtggctatctcttgagctcataccaagaggttagatctgtggtactgcatacactgaaccgtgcaagatttacagtagcagtggaatcctttatcaagacggggcgggttccctcactacagcaaggtaatatccaagaaaagatatttacttttccatgggttgaggatcgaccggtgatgcttggagccagatttaaggatgcattccaagacccctgcacatatctggcagtaaagccttttttcgataaagaaagatacatggtgacttacagccctaccaagggtaaagtctatgcactgctcaaggaccaggctagctcagatgacattctcaaagctgcatttcatgcacatgtgcttcttcattttatgaatcaatcaaaaggtggtgcctcaaaatcggttgagcaactggatcctcctgcttttgctccaatggaatatgagctggagtctcggattgctgaktcgtgtgaaatggtgtctacctcttatggaatcttcaaaagcagtgctgcggaacagggatggagaatgtcagaatctcttctaatcctggccgggctaggttatgtcatatgaatgatgaggaggagtagccacgcatcgtgaagctgggccttggtt

SEQ ID NO: 745 - DNA, 780 bp, Ocimum basilicum
actccgcagtcgccggttgatgagttagtaacattcataagatcctacgttgttccagaaggttttccagacagtgtcacgccttcctatgtaccttacatgacttggagagctttgaagcacttctttggtggagccatgggtgtttttaccacacaaaccctccttagttcacttggagtggccagaaataaagcaacaccaggtgctgtagctatcaattggatcctcaaggatggtgctggacgggttgggaagatgctctttgctcgacaggggaagaaatttgattacgatttaaagcagcttaggtttgctggtgatcttcttatggaattgggagctggagtagagttggcaactgctgctgtcccccatctttttcttccattggcatgtgctgctaatgtggcaaagaatgttgctgctgttacatcaacttcaactcgaactccaatatataaagcctttgccaaaggagaaaatataggagatgtcactgccaagggagaatgtgttggaaatttggcagatctgcttggaactggactcagcataatgatttctaaaagaaatccatccttgtttgccacgtttggtttgctctcctttggatatgtcatgagctcatatcaagaggtgaaatctgttgttttgcacacgctaaatcgtgcacgattcactatggcagcagaatcatttctaaagacagggcgtgttccaagtttgcaagagggaaatttaatggagaatattttcgttcccccatggaaacaacac

SEQ ID NO: 746 - DNA, 990 bp, Brassica napus; identical to SEQ ID NO: 426

SEQ ID NO: 747 - DNA, 1356 bp, Brassica napus
ggacaaccagaaactatctctctctctcttttttctattgtctcttttacaattatccaatagaatattaaccaatggagtcaccaagtcttccagtaacggcaaaagactggacctccaccagtctccaccgtgtactatgtatgcaaggcggtgaaggtgacgtcagctacgtcaacaattccgattgccaagctttggctataaccttatgcaaaccaatccttatctcatctctccaatccatcaaactcttcacctctccgatcatcagaatagctgaccttggctgcgccaccggctccaacactttcgataccgtggatacggtggttgagactttacgtcagctattcactacggtgtacggtggtggatcgctggagtttgaggcttttttctgtgatttgcctagtaatgacttcaacatgttgtttagattgttgtctgagaaacagaaagttgattcgtccaaatatttcgccggcggcgtcgctggctcgttctatgaccggcttttcccgagaggaacgatccatgtcgctgtgagcttaagtgctctacattggctctctcagataccggagaaagtactggagaaagggtcaagaacatggaacaaagggagaacgtggatcgaaggggcgaagaaagaagtggttgatgcatacacagagcaatcagacaaagatttggatgatttcttgaagtgtcggaaagaagaaatggtggagggaggagtgttgtttgtattaatgggtggtcgtccttcaggttcaagtagtcaatttggtgatcaggatactcgagccaaacatcctttcacaactaccatggaacaagcttggcaagatttaatagatgagggttcgatagatgaagagacaagagacggattcaacataccggcgtacatgagaagtccggaggaagtggctgccggaatagaccgtatcggtggtttcaagatagagaaaatggaatacatgaaaatcgttgaatcctccgacgagaaacatgaggagtggaaaaaagatcccgtttcgtacggacgagccaggaccaacttggttcaagctgctattcgtcctatggtcgacgtctatcttggagtggacctatgcgatgagctcttcaaaagatatgaaaaccgggtttctacaacccgagaatttcttcatataacttgtttctttggagtcgtcgctttttctgccatccgaattgaatgattatatgtttatagcgttatgtatgaaatgtgtttgttcgtatttatctatgggttgtcgtttgttttaatatatgaatgtgtgtcgcgtttacttgctggaaaatgtaaactggaattggggt

SEQ ID NO: 748 - DNA, 1408 bp, Arabidopsis thaliana
gagtgacaaagacgaacgaagaccacgactagctcttcccatggcttcttcactgaagaagcttatctcaagctttctacttgtcttatactctaccaccatcattgttgcttcatcagaatctcgatgtcggcgctttacatctatcatcagctttggtgattccatcgcagacaccggaaatattctccatctctccgacgtcaatcatcttcctcaaaccgccttttttccttatggtgaaagcttcttccatcctccctctggtcgtgcctctgatggccgtctcatcatcgacttcatcgctgaattcttgggactaccgtatgttccaccttactttggatcccaaaacgttagctttgaacaagggatcaatttcgcggtgtatggagcaaccgcattggaccgagcgtattttgtggcaaaaggaattgaatctgatttcaccaacgttagtttaggtgttcagcttgacatcttcaagcagattttgcctaacctttgtgcctcatcttctcgtgattgcagagagatgcttggagactcgctgatactcatgggagagattggaggtaacgactttttttacccatcctccgaaggcaaaagtatcaatgaaaccaaactacaggatttgatcatcaaagctatttcttctgcaattgtggtaacaaatctttacacaaatataatcacatatctgttttatactttaacaaattaagcaaccaaactacaggatttgatcgctttagggggcaaaacatttttggtacccggaggcttcccagcaggatgttccgcagcgtgtcttactcaatatcagaacgcgacagaagaagactacgaccccttgacaggttgtatcccacggctcaatgaacttggagagcacgacaacgaacaacttaagacagaactcaaacgactccaaaaactctatcctgatgtcaacatcatttacgctgactaccataactccttataccggttttatcaagaaccagctaaatatgggtttaagaacaaacctttagctgcttgctgtggagtcggaggtaaatacaacttcactattggtaaggagtgtggatacgaaggagttagctattgtcaaaatccttccgagtatgtgaattgggatggttatcatttaaccgaagccgcctaccagaagatggctgagggtatactcaacggtccctatgcaactcctgctttcgactggtcctgccttggctctggtacagtggatacataaaaggagcagttagaattcatttgttgtaaaaaaaaaaaaagaggaagaaaattgtgtgatgatgattaacaaaaagattgcttgtacggcaggatttgactagtgacaaaaatttcgaggatatatgcatcaatcttatcaatg

SEQ ID NO: 749 - DNA, 1411 bp, Arabidopsis thaliana
aataatggcctcatctcttgcattattcagtgatccaaaaagactttaaaaattgagtgacaaagacgaacgaagaccacgattagctcttcccatggcttcttcactgaagaagcttatctcaagctttctacttgtcttatactccaccaccatcattgttgcttcatcagaatctcgatgtaggcgttttaaatcgatcatcagctttggtgattccatcgcagacaccggaaattatctccatctctctgatgtcaatcaccttcctcaatccgcctttcttccttatggcgaaagcttcttccatcctccctccggtcgtgcctctaatggccgtctcatcatcgacttcattgccgaattcttgggactaccatacgtaccgccttactttggatcccaaaacgttagcttcgaacaagggatcaattttgcggtgtatggagcaaccgcattggaccgagcgtttcttttgggaaaaggaattgaatctgatttcaccaatgttagtttaagtgttcagcttgacaccttcaagcagattttgcctaacttatgcgcctcgtctactcgtgattgcaaagagatgcttggagactcgctgatactcatgggagagattggaggaaacgactataattacccattttttgaaggaaaaagtatcaatgaaatcaaagagcttgttcctctaatcgtcaaagctatttcttctgctattgtggatttgattgatttagggggcaaaacatttttggtacccggaggcttcccaacaggatgttctgcggcgtatcttactctatttcagaccgtggcagaaaaagaccaggaccctttaacaggttgttacccattgctcaacgaatttggcgagcaccacaacgaacagctaaagacagaactcaagcgactccaaaaattctatcctcatgtcaacatcatttacgctgactaccacaactccttataccggttttatcaagaaccagctaaatacgggtttaagaacaaacctttagctgcttgctgtggagtcggaggtaaatacaacttcactattggtaaggagtgtggatacgaaggagttaactattgtcaaaatccttctgagtatgtgaactgggatggttatcatttaaccgaagccgcctaccagaagatgactgagggtatactcaacggtccctatgcaactcctgctttcgactggtcctgccttggctctggtacagtggatacataaagggtattctttcagcagtaagaattcattcgttgtaaaaaatcaaagaggaagaaaattatgtgatgatgatgatgatgatgatgattaacaaaaacattgcttgtacggcaagacttgactaatgacaaaacttccgaggatatatggctatatgcatat

SEQ ID NO: 750 - DNA, 767 bp, Brassica rapa
attatttaatacccccaaaaaaaagagaagtaccaaagttgagttgacagagacaacgagactgtccgatggcttctccattgaagaagctcatctcaacctttttgtttctcctatcctccactgtcatcatggttgcctcatcagaaccactgtgtcatccttataaatcgatcataagcttcggtgattccatagccgacacaggaaattatctacgtctctccgacgtcaatcatcttcctcaagcggcatttctaccttacggcgaaaccttctttcagcctccctctggccgttactccgacggccgtcttatcatagacttcatcgctgaattcttgggactaccatacgtaccaccttatttcggatctcaaaacgtgagcttcgagcaagggattaattttgcggtgtatggagcaactgccctggatcgtgcatttcttatggaaaaaggaattgaatctgatttcaccaatgttagtttaaatgttcagcttaacacattcaagcagattttacctaacctctgcgcctcgacttctcgtgattgtagagagatgcttggagactcgctaatactcatgggagagattggcgggaatgactataattaccccttcttcgaaggcaaaagtatcaatgggatcaaagagcttgttcctctaatcatcaaaactatttcttcagcaattgtggatttggtagatttgggaagcaagacctttttggtacctggaaactttccaataggatgttctgcg

SEQ ID NO: 751 - DNA, 610 bp, Raphanus sativus
ggattcgaagcattactctcttcgcgtgtgagtctgtgacgataaacatgggagctctcgagtttctctccgactatttctccaataatttcgatgtttctataagaaaacggaagaagcataaagtcatgcagacagtgaatataaaggtgaagatagactgtgacggatgcgaacgcaaaatcaagaacgctgtttccttcatgaaaggggcaaaatcggtggaagtgaatagaaagatgcacaaagtgacggtgagtggctacgtgcatcccaagaaagtattgaagagagtgcaaagcactgggaagaagaaagctgagttatggccgtacgttccttacacgatggtggcttatccgtacgcagctggagcttacgacaagagggcaccagcgggttttgtgaggaagtctgagcaggctcaggcgcaaccgggaggtacagacgataagctcatgtcccttttcagcgacgagaaccctaacgcctgcatcgtcatgtgaatgagtttgtaaattataattagcaacgtttttctatctttatgaagtttgtattgtaatcttcttggtattgtatataataagaagcaaagcaacttatagca

SEQ ID NO: 752 - DNA, 484 bp, Thellungiella halophila
gcacgaggctctctctctaaagatatctctctctctctctaggacagtaaacatgggagctttggattttctctccgactatctatcagaccatttctacgtttcaataagaaaacggaagaagcataaagtcatgcagacggtgaatataaaggtgaagatagactgtgacggatgcgaacgcaaaatcaagaacgctgtttcctccatgaaaggagcaaaatctgtggaagtgaatagaaagatgaacaaagtgacggtaagtggttacgtggatcctaagaaagtgttgaagagagtgcaaagcactgggaagaagaaagctgagttgtggccgtacgttccgtacacaatggtggcttatccgtacgcagctggagcttacgacaagagagccccaccgggttttgtgaggaaatcggagcaggctcaggcgcagccgggaggtacagacgataagctcatgtcccttttcagcgacgag

SEQ ID NO: 753 - DNA, 1669 bp, Brassica napus
attgacataagacctcctgacgatgagacccatctcgttagctggaaatctcagcttgaacgcgacatgaacatgatccaaactcaggacaataggaaccatatcatggaggttttgtctgagaatgatcttatatgcgacgacctcgaatcgatctcttttgaggacacaaaggttttgagcaattacatcgaagagattgtcgtctctgctctctcttatcatctcatgaacaacaaagatcctgagtacagaaatggaaagctcgttatatcttccacaagtttgtcgcatggattcagcctcttcagagaaggaaaagcaagtggtcgtgagaagctgaaacaaaccgctaaggaagacaaatccaaggaaccaaaagctgaattagcggctgctgtcaaaccggataccaaaccagagagcatcgctaccgcaagcagcagcaagaccgaaccggagaaagaaactaaatctgagaaagcagcaactcctaaagctgcggaagttccgccggataacgagttcgagaaacggataagaccggaagtaatcccagcagaagaaatcaacgtgacattcgaagacatcggtgcacttgacgacataaaagaatcactacaagagcttgtaatgcttcctctccgcagaccagatctcttcacaggtggtctcttaaagccctgcagrggaatcctgctcttcggcccgcctgggaccggtaaaacaatgctggytaaagccatagcgagagaggcgggagccagtttcataaacgtttccatgtcgaccataacttcgaaatggtttggagaagacgagaagaatgttagggccttgtttactctggcttcgaaagtgtcgcccacgattatattcgtggacgaagttgatagtatgttgggacagagaacgagagttggagaacatgaagccatgaggaagattaagaatgagtttatgagtcattgggatgggttgatgactaaacctggtgagcgtatcttagtccttgctgctactaatcgaccttttgatctagacgaggccattatcagacggtttgaacgaaggattttggtgggactaccaggtgtagagaacagagagaagatactaaagacattgttggcaaaagaggaagtggatgaaaacttggattacaaggaactttcaatgatgacagaaggttacacaggaagcgacctcaagaatctgtgcacaactgctgcgtataggccagtgagagaacttatacagcaagagaggatcaaagatactgagaagaagaaacagagagaggctacaaagacaagtgaagatgatgaagggaaagaagagagaattatcacactacgtccgttgaacagacaagattttaaagaagccaagaatcaggtggcagcgagttttgcggcagagggagctggaatgggagaactgaagcagtggaatgagttgtatggagaaggaggatccaggaagaaagaacaactcacttacttcttgtgatgatgatgatgatcttcttgtgatgatgatgatgatgaatcaaatgaataaagacacggtactatgttggatgtgaactcagtttggtaatgtaataatattatgatgacytttttcatggttaataataagagaggagaaacgataatatttaatt

SEQ ID NO: 754 - DNA, 585 bp, Brassica oleracea
gaatcatagcaacagagtgaagaagaagaacaagcgatgtcgttaaacacaatcctcacttggagcctcgtcttctttcttttcctcaccgtctccgaccaaaagcccaccgcttatgacgctgtcaaaagctacaacctaccacccggaatcctcccaaaaggcgtcgttgactacgagcttaaccccaaaaccggcgatttcaaagtctatttcaacggcacgtgtgatttctccatccagtcgtaccagctcaagtacaaatcaactatctccggcgttatatccaccggccaagtcaagaatctgaaaggcgttagcgttaaggtgctttttttctgggtcaatattgttgaggtgtctcttgacggcggcgatcttgatttctcagtcgggattgcgtcggcgagtttcccggcggttgattttgaggagagtcctcagtgtggttgtgggtttgattgtaatgggcttttattttcttcttgaatatattaggccttgtcttgtaccaaataaaaaggccttttgtgatgactatgagccgtgaggaggattaagtttattaataaataacttataatg

SEQ ID NO: 755 - DNA, 598 bp, Brassica napus
gaacacaactagacacgaatcatagcaacagagtgaagaagaacaacaagcgatgtcgttaaacacaatcctcacttggagcctcgtcttctttcttttcctcaccgtctccgaccaaaagcccaccgcttacgacgctgtcaaaagctacaacctaccgcccggaatcctcccaaagggagtcgttgactacgagcttaaccgtaaaaccggcgatttcaaagtctacttcaacggcacgtgtgatttctcaatccaatcgtaccagctcaagtacaaatcaactatctccggggttatatcagccggccaagtcaagaatctgaaaggcgttagcgttaaggtgctttttttctgggtcaatattgttgaggtgtctcttgacggcggcgatcttgatttctcagtcgggattgcgtcggcgagtttcccggcggttgattttgaggagagtcctcagtgtggctgtgggtttgattgtaatgggcttttattttcttcttgaatctattaggcctttatgttgtaccraataaaaaggccttttgtttttagtatgagccagsgagatgattaagtttattaaataaataactta

SEQ ID NO: 756 - DNA, 619 bp, Brassica napus
acaactagacacgaatcatagcaacagagtgaagaagaagaacaagcgatgtcgttaaacacaatcctcacttggagcctcgtcttctttcttttcctcaccgtctccgaccaaaagcccaccgcttatgacgctgtcaaaagctacaatttaccaccaggaatcctcccaaagggcgtcgttgactacgagcttaaccccaaaaccggcgatttcaaagtctatttcaacggcacgtgtgatttctccatccagtcgtaccagctcaagtacaaatcaactatctccggcgttatatccaccggccaagtcaagaatctgaaaggcgttagcgttaaggtgctttttttctgggtcaatattgttgaggtgtctcttgacggcggcgatcttgatttctccgtcgggattgcgtcggcgagtttcccggcggttgattttgaggagagtcctcagtgtggatgtgggttcgattgtaatgggcttttgttttcttcttgaatctattaggccttatgttgtaccaaataaaaggccttttgtttttagtatgagccatggcgatgattaagtttattaaataaataacttataatatgtgtattagtatttggtttag

SEQ ID NO: 757 - DNA, 681 bp, Brassica oleracea
gctcttaacgtttattcatttctatatctactaaagaacctttatttcatttccattactacatctatacataaatggcratggaatgcatcacagctctccctcaaagattcagtgaaaacaaaaccaaagaggatccttcaatcttcgatgcaaatctcctgaaccagcagtcaaaccacatacctcaacagttcgtatggcccgaccacgagaaaccttcctcggatgttcaacctctccaagtccctctcgtagaccttgccggtttcctctctggtgacccgttcttagtctcggaggctactagactcgtctctgaggcttcaaagaaacatggcttcttcctagtcacwaaccatggagttgatgagacgctcttgtctcgtgcccatctctttatggactctttctttaaggctcccgcttgtgagaaacagaaggctaggaggaagtggggcgagagctccggttacgctagtagcttcgttgggagatactcctctaagctcccgtggaaggaaacgctgtcgtttwagttctcgcccgaggagaagtgccattcccaaaacatcaaagactttgtttctgaaaaaatgggagatggatatgacgatttcggaaaggtttatcaagaatatgctgaggccatgaacattctctcactaaagatcatggagc

SEQ ID NO: 758 - DNA, 1410 bp, Brassica napus
cttaacgtttattcatttctatatctactaaagaacctttatttcatttccattactacatctatacataaatggcaatggaatgcatcacagctctccctcaaagattcagtgaaaacaaaaccaaagaggatccttcaatcttcgatgcaaatctcctgaaccagcagtcaaaccacatacctcaacagttcgtatggcccgaccacgagaaaccttcctcggatgttcaacctctccaagtccctctcgtagaccttgccggtttcctctctggtgacccgttcttagtctcggaggctactagactcgtctctgaggcttcaaagaaacatggcttcttcctagtcactaaccatggagttgatgagacgctcttgtctcgtgcccatctctttatggactctttctttaaggctcccgcttgtgagaaacagaaggctaggaggaagtggggcgagagctccggttacgctagtagcttcgttgggagatactcctctaagctcccgtggaaggaaacgctgtcgtttaagttctcgcccgaggagaagtgccattcccaaaacatcaaagactttgtttctgaaaaaatgggagatggatatgacgatttcggaaaggtttatcaagaatatgctgaggccatgaacattctctcactaaagatcatggagctgcttggaatgtgtcttgggatcgagaggagacattttagagacttttttgaagacaatgagtcaatattaaggttgaattactatccgcagtgcaagcaaccggagcttgcattagggacaggacctcactgcgacccaacrtctctaaccatacttcatcaagaccaagtcgatggtcttgaagttttcgtggacaacaaatggcaatccattcctcctaaccctcaatcagtcgttgtcaacataggcgacactttcatggcgttaacaaatggtatatacaagagttgtttgcatcgggcggtggtgaacagcgagaaggataggaaaacattggcattcttcctatgtccgaaaaaagacaaagtagtgaagccaccagaagaactagtaagagtgatgtctggtgaaagagagtatcctgattttacatggtctatgtttcttgagttcacacagaagcattatagatcagacatgaacactcttgaagagttctcaaattggcttaagaacagaagaagtttctaaaataaggagacaatgatgtggtccagaagacttgtagattcttaagagacagtagagatcactctgataaggagccttttgtcttttgttttgattatttattagcttgtttttatggwggttggtgtaagataaaatttgcaaataaataaatatatgtacttcactggtgatgttatcatttagtgatgatttctat

SEQ ID NO: 759 - DNA, 723 bp, Brassica napus
aaagacctttaaaggatctttcatttccactactatatatttatatacacataaagataaatggcaatggaatgcatcgcaactctccctgaaaggttcaatgataacaaaaccaaagaggatccttcaatcttcgatgcaaatctcctaaatcagttatcaaaccacatacctcaacagtttgtatggcccgaccacgagaaaccttccacggatgttcaacctctccaagcccctctcatagacctcgccggtttcctctccggcgattcgttcttggtctcagaagctactagactcgtctctgaggcttcaaagaaacatggcttcttcctagttactaaccatggtgttgatgaaacgctcttgtctcgtgcctatctgtttatggactctttctttaaggctccggcttgtgagaaacaaaaggctcagaggacttggggtgagtcctccggctatgctagtagcttcgtagggagattctcctctaagctcccctggaaggaaacgctgtcgtttaaattctctcccgaggagaagtgccaatcccaagccgtcaaagactttgtttctaagaaaatgggagatgaatatgaaaatttcgggaaagtctatcaagaatacgccgatgccatgaacattctctcattaaagatcatggagcttcttggaatgagtcttggaatcgagaggagacattttcgaaactttttcgaagac

SEQ ID NO: 760 - DNA, 674 bp, Brassica napus
aaccctctcctctacaaagtccagtcacctgatgagttctccgatctccttatcctctcctactccaacttcattcagaatttatattctttaggagcaagaaggataggagtgactacacttccaccattgggatgtttaccagcggccataacagtggctggtccacacgagggtggatgctcagagagtcttaacaacgacgcaatctccttcaacaccaaactcaatgcgacttcgcaggatcttaagagaaacctcattggactcaacttagtcgtcttcgatatctatcagcctctctatgatctcgccacaagaccatccgaatttggatttgcagaggcaagaagagcatgttgtggaacaggactactagagacatcaatactgtgtaaccctaaatcagtagggacatgtactaatgcaactgagtatgtattttgggacgggttccatccaacagaagctgctaacaagattctctcagacaatctcttgctctctggcatctctctcatctcctaatgatcbatctctctttcttctcgagatcattgttgcttttgactatggcttaagatttgttacttccactatgtgctgttgttttgcccatttgaatttcaagacaatcgagatttatytmgagactctgaatcttctcggttctg

SEQ ID NO: 761 - DNA, 1012 bp, Brassica rapa
acagagaaaaaaaattgaagaaaataacaaagagaagaaaaaaaaaatgtcatcttcttcatcaagaaacgcctttgtggatggcaaatacaaaccagatcttttaacagtggatttagcatctcgctgtcgctgctacaaaacgacgccatcttcttctctgactccgccgcctcctcccaagtcgcttttggtggcaacgccggtggaggaaggagaatatccggtggtgatgctcctccatggttaccttctctacaactcattttactcccagcttatgttgcatgtctcttcctatggcttcattgtcatcgctccgcagttatataacattgccggaccagacacgatggacgagataaaatcaacggcggagattattgattggttatcagtcggacttaaccactttcttccaccacaagtaacacccaacctatctaaattcgcactcaccggccatagccgcggcggcaaaaccgcattcgccgtggccttaaagaaatttggatactcatcggaactaaagatctcagcacttatcggtgtagatccggtggatgggacagggaaaggtaaacaaacccctcctccggttttaacctatgaaccaaactcatttaacctagaaaagatgcctgttctagttattggttcgggacttggtgaacttgcccggaacccattgtttccaccgtgtgcacctacgggagtgaaccaccgagagtttttccaggaatgtcaaggtccagcgtggcattttgtcgcaaaggattacggacatttagacatgcttgatgatgatacaaaagggcttagagggaagagttcttattgtttgtgtaagaatggtgaagagagaaaaccaatgaggagatttattggtggtattgttgtgtcgtttttgatggcttatctggaaratgatgattgtgagttgatgaagatcaaaaatgggtgtcatgaargtgktcctgttgaaattcaaarrwtttgagggttaaaaagt

SEQ ID NO: 762 - DNA, 1354 bp, Raphanus sativus
ggaaaccaaaaaaaaaaaaggtgaaataacaaagcgaagaaaaaaaatgccttcttcttcatcaagaaacgcctttgtggatggcaaacacaaaacagatctcttaacagtggacttatctcgctgctgcaaaacgacaccatcttcttctatgactccgccgcctcctcccaagggactgttggtggcaaccccggtggaggaaggagaatatccggtcgtgatgctcctccatggttaccttctctacaactcattttactcccagcttatgttgcatgtctcttcccatggcttcatagtcatagctccgcagttatatagcattgctggaccagatacgatggacgagataaaatcaacggcggagattattgattggttatcagacggacttgaycactttcttccaccacaagtaacwccagacctatccaaatttgcactctccggccatagccgcggcggtaaaacwgcattttccgtggccctaaagaaatttggatactcatccgacctaaagatctcggcacttatcggtatagacccagttgatggaacagggaaagggaaacaaacccctcctccggttttaacctatgagccaaactcatttgacctagacaagatgcatgttttagtgatcggttcaggacttggtgaacttgcccggaacccgttgtttccaccgtgtgcgcctccgggagtgaaccaccgagagtttttccgggaaagtcaaggcccagcgtggcattttgtcgcaaagggttacgggcatttggacatgcttgatgatgataccaaagggcttagagggaagagttcttattgtttgtgtaagaatggtgaacagagaagaccaatgaggatatttgttggtggaattgttgtgtcgtttttgatggcttgtctggaaggagatgaacgtgaattggtgaagatcaaagatgggggtcatgaaggtcttcctgtcgaaattcaagagtttgaagttaaaaagtaattttctttagggcttgtttttcttattttcaacatatattaatagtcacttttgttgcttatgaagttatattgtgtggtctttacttaagcgacatcttggctcatgaaactaacccgatcgcattcaaaatctagtagtgtaaacttatatatattccgcaactacaataatcaaaacaacaagcatgatattggatggatctagtagaaaaataaaaaatcaaataatttggtttctaggtcaagtgtcatcagtgttagattaacctcacaactatacaacaacgacttattcttcttcttccccccatcgagaagtgcctagtgggcaaaaagatgcttaaagtgc

SEQ ID NO: 763 - DNA, 2061 bp, Brassica rapa
gaatctctcgagtctcaaaacccttgagggaagagcttaaaaagacgagaaaccttccactattcccaaagtcgtgaaatcagcagagatattctctttatttctctctctcacccatccaaaaaacttcacgagtccccaaggaaagaaaaaaaaactctatttccaaagatgaagaacaataacaacaaatcttcttctagctatgattcttctttgtctccttcttcttcatctacttcccaccagaactggctctcattttctctctctaacaacaataacttcaactcttcctcaaaccctaatctcgccacctccacatctgatcatcatcatcatcctcacccttctcacgtatctctctttcaagctttctccacaactccagttcaccggcacgatgagtcaccgggaacttccagcggcgatgccacagcggctctttccatgtaccccggcggtccaaaactcgagaatttcctcggcggtggagccacaacgacgacgacaggacaaatgcaacaaggtcaatctcttggcggcgttgtcttctcttctaacgtagagcagccacgtcatcctccgtcggccgccgagatctatgactacgagctcaaatccatagctgctagcttcctcgggaactattcaggtggacattcatcggaagtatctagcggacaaaaacaacaacataaccctccaactgccacagaggcttccccgacgccaaagaagratgtagagagtttcggacaacgtacttcgatttatagaggggtcacaaggcatagatggactggaagatacgaagctcatctatgggataacagttgccgaagagaaggccaaagcagaaaaggaagacaagtktatttaggtggttatgacaaggaagacaaagctgctagagcttatgatcttgcagctcttaagtattggggtcctacaactactatgaatttctcgatatcgaattatgagcctgaacttgaagagatgaaacacatgactcgacaagagttcgttgcttctctgagacggaaaagcagtgggttctctaggggtgcctccatgtacagaggtgttactagacatcatcagcatggtcgatggcaggcacgaattggaagggttgcgggaaacaaagacctttaccttggcacattcagcactcaagaggaggctgcagaggcttatgatatagcggctattaagttccgagggctaaatgcagtaaccaactttgatatcagccgctatgatgtcaagtcgatcgctagctgtaacctccccgtgggtggactaaaccctaaaccatctccagtaaccccagcacctgacaaacaagttgatatatctccatctgatcctccatctctgaccacaccatcactcaccttcaacgcggcaacaccggttcatgaccatgaaggagcctttttccacaccggaatacctatcaaacaagacccagctgcccattactggtccaacgtttttggattcccgccaaacctgaaaaccgagacccgaccaatagcaacctttggttcggaccttcacagcacctctccggggtttactgttatgccggtaatgcaagacggaggaaacaactttggtggtgggtttgttgagtcagaagggtataataacaatcattcagctgcatcaagtcctgtctcagcaattcctctgccctcaacggtagataacagtaacgaaggatatggtgggaacataaattggataagtaacaacacttcaaattcgtaccaaactgccaagtcaaatctctccgtcttgcagactccggtttttggattggaatgagctctcaaacttatcttagtgagtaccaaagaaaaggttgtaggataataaagaacggcgttgtttgaaatgggatattctcttgttagattatttaagtagttttcttaaagatattttcaagttttttcacttttatgcttgtctattgaccaagaattttgcggggatctgacagtactaactctttgtgtttaatggctttatgggttcctttttctc

SEQ ID NO: 764 - DNA, 796 bp, Brassica napus
gatccgggaaacacataactaagtagagagataccaaagggtccacgaaagacccgtgctcagctttgattctcttgatctcttcggtttcatttatttttttataatcattttttcttgtgcgacttggatcaatctcatcgatctgaaagaatgaagcgtgagtatttggattacatattggtaccattagggatgggtttgatgatattctatcatctgtggcttctccaccgtatcattcatcgcccatcttccactgtcgttggcctcaacgccttcaatcgccgcctttgggtccaagccatgatggaggacgcacctaaaaatggtgttctagcggttcaaacgctaaggaacaacataatggcgtcaacactattggcatcaaccgcaataatgctgtgttcactaatcgcggtactaatgactagcggtacaggrgaacgatcggtatggtttgtgtttggagacaaaagcgaccaagctttctccatyaagtttttcgcaatccttgtttgcttcttagtcgcgtttcttctaaacgtccaatcaatccgttattacagccatgcaagcatcctcatcaatgtcccttttaaacagctcatggctgtttcttcgggtggtcatagtcttatgataaaccaagactatgtggctgcaacagttaaccgtgggagctacttctggtcgttaggactaagagcgttctacttctcatcgcctttgttcctatggatctttggtcccatcccgatgttcattacttgttgcgttcttgtttcgttgttgt

SEQ ID NO: 765 - DNA, 888 bp, Brassica napus
ggagaatccgggaagcacaatacgaagcaaagagagagagagagatagggtagcattagatacggaacggtccacttaagtaccgtgtttcattttgattctctcaatcactctcgtctcccttcatttttcttttactattattattttctctgaacttgatcaatcttattgatctagaaaatgaagctcgagtatttggattacatattggtgccattaggtatgggtttgatggtattctatcatctctggcttctccaccgcatcatccaccgtccatcttccaccgtcgttggcctcaacgccttcaaccgccgcctctgggtccaagccatgatggaggattcatcaaagaacggcgttctagcggttcaaacgctaagaaacaacataatggcatcaactctattggcatcaaccgcgataatgttgtgttcactaatcgctgtcctaatgactagcggtacaggagaacgatcggtctggtttgtgtttggagacaaaagcgaccgagccttctcgatcaagtttttctcaatcctcgtttgcttcctagttgcgtttcttctcaacgtccaatcaatacgttactacagccatgcaagcatcctcatcaatgtccctttcaaaaagctcatggctgtttcttcagatggtcatggtcgtggtagtcttatgataaaccaagactatgtggctgcgacggttaaccgtgggagctacttctggtcgttaggactaagagcgttctacttctcatcgcctttgttcctatggatctttggtcccatcccaatgctcataacttgctgcgttctagtttctttgttgtactttcttgatttaacgttcgactcgatggattgtagcgttggggtcgcggac

SEQ ID NO: 766 - DNA, 986 bp, Raphanus sativus
gacataagacccgtactccactttgattctcttaatctctcttcgctctgccttcattttcttttattattaatttcttctgtgaacttagatcaatctcattgatctaagaaaaatgaagcttgagtatttggattacatattggtgccactagggatgggtttgatggttttctatcatctctggcttctccaccgcatcattcaccgtccatcttccaccgtcgttggcctcaacgcctttaaccgccgcctctgggtccaagccatgatggaggattcatcaaagaacggcgttctagcggttcaaacgctragaaacaacataatggcgtcaactctattggcatcaaccgcgataatgttatgttcactaatcgctgtcctaatgactagcggtacaggagaacggtcggtctggtttgtgtttggagacaaaagcgaccgagccttctcgatcaagtttttctcaatcctcgtttgcttcttagtggcgtttcttctcaacgtccaatcaatccgctactacagccatgcaagcattctcatcaatgtccctttcaaaaagctcatggctgtttctgcgggtggtcatggtcgcggtagtcttatgataaaccaagactatgtggctgcaactgttaaccgtggcagctacttctggtcgttaggactaagagcgttctacttctcatcgcctttgtttttatggatctttggtcccatcccaatgctcataacttgctgcgttcttgtttctttgttgtactttcttgatttaacattcgactcgatggattgtagcgttggggtcgcggacgcggaggagactgagattagaagcttagctgacaatgtgtagtaatagttgagatatctttcttaacatattggtttcataagttgtatcgattcaggttcaatggttgttgaaccatgtcagcgagttattctgttgtttagtgaataaaacgttattatctcca

SEQ ID NO: 767 - DNA, 1298 bp, Brassica rapa
gacaagatggttgattatctccgtagctctgttgggattattcacaggaaccacgcggagagcatcacaacgttcatcaaagagagcgtagactcagagctcaaggaccctaatgcgaaccccaagaagcgtttgacgttttgtgtcgaagggaacattagtgtaggcaaatcaacttttcttcaaagaatagctaacgagactatcgagctgcgtgacctcgttgagatagttcccgagccggttgacaagtggcaagacgttggaccagaccacttcaatatactagacgctttctactcagagcctcagaggtacgcttacactttccagaactacgtgttcgtcacgcgcctgatgcaggagaaagagtctgcttctggggttaagcctctcaggttgatggagaggagcgtcttcagtgacagaatggtgtttgtgagggcggttcatgaggcgaagtggatgaacgagatggagataagcatatatgattcttggtttgatccggttgtctctgctttacctgggcttgttcctgatgggttcatatacttgagggcgagtccggacacttgccacaagaggatgatgctgaggaaacgagcggaagaaggtggagtctcgctgaagtacctccaggatttgcacgagaagcatgagagctggctcttaccgtttgagagtgggaaccatggggtactgtctgttagtaaaccgtctttacagatggataacaactctctgcatccggatataaaagaccgtgtgttttacttggaaggaaaccatatgcattctagcatccagaaggtccctgctttggttttggactgtgaaccaaacattgacttcagccgagatattgaagcaaagagacagtatgcacgccaggttgctgagttctttgagtttgtgaagaaaaagcaagaaacatcgcaagagaagggcaacagtcagtctccgttgctgatacctcctcaaaagggaggtctctggatgggaccagaaggcaagcatgtcccgggattagaactcgagtctcttgatttcagaaaggccatgtcgctcttaaccagaccgtctgcatagatagactgtccacagacgctgtttttttctttgctctgaaggagcatgtccgaatgtcaataggtatgtatggtcggcttttgtttccctcttagatgtagaaacaatgttttgtttgtttggttagttataacccttttgtgtagagaagcttaatgtctggacacttatattagatatgttgtttcttgaaatttttgatggtc

SEQ ID NO: 768 - DNA, 1119 bp, Raphanus sativus
gcarassatagctaacgagactatygagytgcgtgaccttgtygagatagttcctgarccggttgataagtggcaagacgttggacctgaccatttcaatatactagaygctttctactccgagcctcagagrtatgcytacactttccagaactatgtgttcgtcacgaggctgatgcaggagaaagagtctgcttctggggttaagcctctcaggttgatggaaaggagtgtcttcagtgacagaatggtgtttgtgagagcggttcatgaagcgaagtggatgaacgagatggagataagcatatacgactcgtggttygatcccgtcgtctctgctttacctggacttgtacctgatgggtttatatacctgagggcgagtccwgacacttgccacaagaggatgatgctgaggaaacgtgcggaagaaggtggagtgtcgctgaagtatctgcaggatctgcacgagaagcatgagagctggctactaccgtttgagagtgggaaccatggggtgctctccgttagcaaaccgtctttgcagatggataactctctccatcctgatatcaaagaccgtgtcttttacttggaagggaatcatatgcattctagcatccagaaggtgcctgctctggttttggactgtgagccaaatattgacttcagtagagatattgaagcaaagagacagtatgcaagacaagttgctgagttctttgagtttgtgaagaagaagcaagaaacgtcrcaagagcagtcgccgttgttgatgccacctcataatggaggtctctggatgggaccagaagggaagcatgtcccgggactagaactcccgtctctggatttcaggaaggccatgtcgctcataaccagaccgtctgcgtgagrctgtcccccwcacrgactcagtttttttgttttgtttgctctgaaggagcattgtccgggttatcatggaatgtcaataggtattgtcggctttatgtttcgtttgttttagggaacttctctcaacggtttttacccctctcttagtttagttataacccttttgtgtagagaagattgatgatgtctggataattttggtttaagtgttctgtttcttga

SEQ ID NO: 769 - DNA, 997 bp, Brassica rapa
gataatcaaaaacacataaagggagawtcyytscrtyggaacttcttgaagagaaatggcttcttcttcttcttcgkctgctctttatagaatctcaaatctccagaatcatatctcccctcttgaagcaaccaacaagctaaggagtctggtcaagatatctccacaagtatctgaagccttatccaatggacgtgctgtggtcgctcttgagtcaaccattatctcccatgggatgccttaccctcaaaacctgcaaacagcaaaagaggtggagtctattgtgagagagaatggagcagttcctgccacaatagctatcttgaacggagttccttgcataggtctgaacgaagaagaactagaacgtcttgcatctctggggaaaagtgtccaaaagactgcaggcagggacatagcatatgttgtggctacaagaggaaatggtgcaactacagtctctgcaaccttgtttttcgcttctatggttggcatccaagtctttgtaaccggtggaattgggggtgtacataggcatgccaaccaaactatggacatatcatctgatcttactgcacttggaaggactcctatagctgtgatatcagcaggcgttaaatccatacttgatattccaaagactcttgaatatttggaaactcaagaagtgtatgttgctgcatacaagagcgatgagtttccggcatttttcacagaaaaaagcggctgtaaggcaccttctcgtgtagatagccctgaagactgtgctcgagtaatagatgcaaacaagaagctaaaccgtcaggcagggattctatttgctgttccaatcccgaaacagcattcagccgctggaaatcttatagaatcagcaacacagcgtgctcttacagaagcaagggaacaaaacgttacgggaaatgcagaaactccgttcttgcttgcacggggtaaatgagttaactggaggcacttcacttgcagcaacattgcgctt

SEQ ID NO: 770 - DNA, 1311 bp, Brassica napus
atgtgaatattcttctgcagatttggggtgcagatctcagtgtatattgtttttgtcagtaaagataatcaacaacacataaaggtcgaatctttccgttggtaagttaagagtgtgattcagagagaaatggcttcatcttcgtcctctctttccagaatctcaactctccagaatcatatctcccctcttgaagccaacaacaagctaaggagtctggtcaagatatctccgcaagtgtctgaagccatatccagtggacgtgctgtggtcgctcttgagtcaaccataatctcccatgggatgccttaccctcaaaatctgcagacagcaaaagaggttgagtcaattgtgagagaaaatggggcagtccctgcaacaatagctatattaaacggagtgccttgcataggtctgaacgaagaagaactagaacgtcttgcatctctggggaaaagtatccaaaagactgcaggcagggacataccacatgttgtggcgacaagagcaaatggtgcaactacagtctctgcaacgttgtttttcgcttcaatggttggcatccaagtttttgtaaccggcgggataggaggtgtgcataggcatgccaaccatactatggacatatcatctgatcttactgcactaggaaggactcctatagcagtgatatcagcaggcgttaaatccatacttgatattccaaagactcttgaatatttggaaactcaagaagtgtatgttgctgcatacaagagcgatgagtttccggcatttttcacagaaaaaagcggctgtaaggcaccttctcgtgtmgatagccctgaagactgtgctcgagtaatagatgcaaacawgaagytaaaccgtmaggcrgggattctrttygctgttccaatcccraaacagcattcagcygcyggaaatcttathgaatcagcaacacagcgtgctcttacagaagcaagggaacaaaacgttackggaaatgcmgaaactccrttcttrcttgcacgggtaaatgagttaactggaggcacttcacttgcagcaaayattgcgcttgtgaaaaacaatgcmcttatcggttctcagattgcrgtagcsctttctcagctrrygtgagctwccttatcaayctmaagctcaagctcgattcaggttcatgattcagggcatctcaaaaacgttctggattggtagtwatctagtgttttaatgttkckttaysmaakawwstytyttrmmcatattttcacatgtgtatattaaaatttattttatatatcatgtggaacctgatttaccgcc

SEQ ID NO: 771 - DNA, 1336 bp, Raphanus sativus
ggkggttttgtttcttctacaacggtgagagagttgcagctacttcgtcttcttcgtttcgtgcatcgcgaacttcttcaagagaaatggcttcttcttcctctgctctttatagaatctcraatctccagaatcatatctcccctcttgaggcaaacaacaagcttaggagtctggtgaaggtatctcmagaagtatctgaagccatatccaacggacgtgctgtggtcgctcttgagtcaaccattatctcccatgggatgccttaccctcagaatctgcaaacagcaaaagaggttgagtcaattgtgagagagaatggagctgtccctgccacaattgctatcttgaacggagtaccttgcattggtctgaacgaagaagagcttgagcgtcttgcatctctagggaaaagtgtccagaaaactgctggcagggacatagcatatgttgtggctacaagaggaaatggtgcaactacagtctctgcaaccttgtttttcgcttcattggttggcatccaagtatttgtaaccggcggaattggaggtgtgcataggcatgctaaccaaactatggacatatcatcygatcttactgcwctcggaaggactcctatagctgtgatatcagcaggcgttaaatccatacttgatattccmaagactcttgaatatttggaaactcaagaagtatatgttgctgcatacaagagcgatgagtttccggcatttttcactgaaaaaagcggttgtaaggcrccttctcgtgtagatagccctgaagamtgtgctcgagtmatagatgcaamcatgaagctaaaccgtcaggcagggattytatttgctgttccaattcctaaacagcattcagccgctggaaaccttatcgaatcagcaayacagcgtgctcttrcagaagcaagggaamaaaacgtkactggaaatgcagaracyccgttcttrcttgcacgggtaaatgagttaactggaggcacttcacttgcagcaaacattgcgcttgtgaaaaacaatgcccttatcggttcgcagattgcagtagccctttytcagctaatgtgatcttccttatcaatytmaagctcargtcagrttcaggttcatgattcamgacatctcaaaaacgttttggattggtagttayggagtgtttttyaatgttgcgtatcaaagatttttttctttagcccagaaaytctttttagcatattttcacatgttatakaramwatatmtwtatatcatgtgaaacctgatatgccggccgccttgtctaacgtttccctataggttaagctattgaattattgatttta

SEQ ID NO: 772 - DNA, 1464 bp, Arabidopsis thaliana
atggaagacgcagagagcaccaccaaagatcctgtagacagagttgagaaagtaacatggagagatctgcaagacggatctttcaccgcagaactcaagaagcttatatgctttgcggctcctatggctgccgtggttatcactcagtccatgttacagatcataacaatggtgattgtgggtcacctcggcagactctctctcgctagcgcttccttcgccatctccttctgtaacgtcactggcttcagcttcattatgggattgtcatgtgccttagatactctcagcggtcaagcctatggagctaagctatatcggaaactaggtgttcaggcttacacagctatgttctgtcttacattagtgtgtctccctctctctctcctatggttcaacatgggaaagcttctcgtgatccttggccaagacccttcaattgcacacgaagccggaagatttgctgcttggctcatcccaggactgtttgcttacgctgttctacagccgcttactcgctacttcaaaaaccagagcttgataacacctctccttatcacctcttgtgttgtgttctgtctccatgttcctctttgttggcttttggtttataagtcagggcttgatcatattggaggagccttggctctcagtttgtcatactggctctatgccatctttcttggatctttcatgtacttctcctctgcttgttctgagacacgtgcaccgcttaccatggagatattcgagggcgttagagagtttatcaaatatgctcttccttctgcggctatgctttgcctagagtggtggtcttatgaactcataatattactatctggtctcttacccaacccacaactggagacttctgtgctctctgtctgtctccaaacactttcgatgacttattcgataccactagcgattgcagctgcagcaagcacaagaatctcaaatgaattaggtgctggaaactctcgagcagcacatattgtggtctacgcggcaatgtctcttgcagtagtggatgcattgatggtgggtacgtctctattagctggtaagaatctgttgggccaagttttcagcagtgacaagaataccatcgactatgttgcaaagatggctccactggtctctatttctctcatactggacagtttacaaggggttctctcaggtgttgcaagcggatgcgggtggcagcatataggggcttacataaactttggagctttctatctctgggggatacccattgctgcatctttagccttctgggttcatctgaaaggtgttggcctttggattggaataatagccggtgccgttctgcaaactcttctgctggctcttgtcacaggctgcataaactgggaaaaccaggctcgtgaagcgaggaagcgaatggctgtggcccatgaatcagaacttacagagtcagaacttcccttttaa

SEQ ID NO: 773 - DNA, 527 bp, Brassica oleracea
gtactgtactttactctaaccccccaaaacaaaagttttctctcctccccatcttcctttaaaaaaatgcgtatgagctgtaacggatgtcgagttcttcgaaaaggctgcagtgaaaactgtagcataagaccgtgtctccaatggatcaaatccgccgaatctcaagccaacgccaccgtcttcctcgcaaagttctacggtcgtgccggcttaatgaacctcctcagcaccggtcccgaccacctccgtcctgcgatatttagatcgttgttgtacgaagcatgcggaaggattgtgaatccgatttacggatcggtcggcatattatggtctggaaactggcatctttgtcaagcagccgtggaggcggtgatgagaggctctccggtgactccaatcgcatgcgacgcggcggttactggtcaagctcctcctttcaacaacaacaaactctttgacataagacacgtgtctagagacgagaacgccgtgaagagccggtgtcgttcgagccgtagtggtgc

SEQ ID NO: 774 - DNA, 1002 bp, Brassica napus
gaccgtactgtactttactctaaccccccaaaacaaaagttttctctcctccccatcttcctttaaaaaaatgcgtatgagctgtaacggatgtcgagttcttcgaaaaggctgcagtgaaaactgtagcataagaccgtgtctccaatggatcaaatccgccgaatctcaagccaacgccaccgtcttcctcgcaaagttctacggtcgtgccggcttaatgaacctcctcagcaccggtcccgaccacctccgtcctgcgatatttagatcgttgttgtacgaagcatgcggaaggattgtgaatccgatttacggatcggtcggcatattatggtctggaaactggcatctttgtcaagcagccgtggaggcggtgatgagaggctctccggtgactccaatcgcatgcgacgcggcggttactggtcaagctcctcctttcaacaacaacaaactctttgacataagacacgtgtctagagacgagaacgccgtgaagagccggtgtcgttcgagccgtagtggtgcatgcaaagaagggagaaacgtgaggtcgtcgcttagtcacgagtcgtcactgagtcatgagtctgcggtggtgaaaggtgaaggaagtatggtttcgtcagaggagacgacggaggaaccgagttggatcgggcttgagctgactttggggttggagccgtctggcgcacgtgggagtcacgtggtggtgccgattaagaaacggaagttggagaagtctggcacgtgcgatgatgatgcggatacgtgtaagattgagcttggactcgtgtgcagcgagtgaaaatgaaatggtctctcttttgctcgtcttagaagtttcttttggttctgtgttgagtttggtgtacaaatagagattaacgaatctttctttctttgtttctggattttaaagtttctttgtttactgtttttgcatgttcggtgttcttcacaagtgtgtatgataaagagatcttaacttttaac

SEQ ID NO: 775 - DNA, 2365 bp, Arabidopsis thaliana
accaatataataaaaataacctagacgaagaacaaacaaaactctctctttctctctctctctctaataagtaaggttttgatctttttcaagatcaaacaaaaacaatggagttagagagtacgagcaatggccgacgtccgccgccaccggcagagattggccgtggggcgtacttggcgtgggaagatttgacggtggttataccaaactttagtggtggtccgactcgaagattgctcgatggattaaacggtcatgctgaaccaggtcggattatggccattatgggtccttccggatccggcaagtccacgcttcttgattctctcgcaggtagactcgcaagaaacgtgattatgaccggtaatcttctattgaacggaaagaaggcaagactagactacggtctcgtcgcttatgtaacacaagaggacattttgatgggaacactaacggtgagggagacaataacatactcagctcatctacggctatcaagtgatttgaccaaagaagaagtcaacgacattgttgaaggaacaatcattgaacttggtcttcaagattgtgcagacagagtcataggtaattggcattctagaggagtgagtggcggcgagaggaaacgcgtcagcgttgcgttagagatcttaacgcgaccgcaaattttgtttcttgatgaacctactagtggtttggacagtgcttctgctttctttgtgattcaagcgctaaggaatatcgctcgagatggtggtagaaccgttgtttcatcgattcatcaacctagtagcgaagtttttgctctctttgatgatctttttttgctctctagtggtgagactgtttattttggtgaatccaagtttgctgttgagttctttgctgaagcggggtttccttgcccgaagaaacggaatccttctgatcatttcctaagatgtatcaactcagactttgataccgttacagctacactcaaaggatctcaaaggattcgggagacaccagctacatcagatcctttgatgaatctagcaacatctgagatcaaagctaggcttgttgagaattatcgtcgttcagtctacgctaaatctgcaaaatctcgcatccgtgaattagctagcattgaaggacatcatgggatggaagtgagaaagggaagcgaagcgacgtggtttaagcagctaagaactttgacaaagagatcatttgtgaacatgtgccgcgatattggatactattggtcaagaattgtgatctatattgtggtatcattctgtgttgggacaatcttttacgatgtaggacatagctacacatcgatcttggctcgggtttcttgtggtggattcattaccggtttcatgactttcatgtccattggagggtttccttctttcattgaagaaatgaaagtgttctataaagagagattgagtggttactacggcgtttcggtttatatcatatcgaattacgtctcttctttcccgttcttggtagccattgcgctcatcacagggagtattacttacaacatggtgaaattccgtcctggtgtctcgcattgggctttcttctgtctcaacatattcttctctgtctccgtcattgagagtctcatgatggttgtggcttctcttgttccgaatttcttgatgggtcttatcacaggagctggcatcattggaatcatcatgatgacttctggattcttccgtttgcttcccgatctgccaaaggttttctggcgctacccgatttccttcatgagttatggttcttgggctattcagggagcatacaagaatgattttcttggtctagagtttgacccgatgtttgcgggggaaccaaagatgacaggagagcaagtgataaacaagatatttggagtgcaagtcacacattctaagtggtgggacttatcagcgatcgtgttgatccttgtgtgttaccgcattctatttttcatagtcttgaagcttaaggagagagcagagccggctttgaaggcgatacaagcaaagcgaacgatgaagagtctcaaaaagagaccttctttcaagaaagttccatctctatcatcactatcttcaaggagacaccaacctctacattcactttcttctcaagaaggtcttacctctccaattaattaaagattatatctatttgtgtatacactttgtttcttaatttgttttgcacatacgatagtttcaacatttataaatatgtatcattatcagcatctaatgattctatgattcagcattgttatttttggagaataaacatgatactctgtatctttcgtctatatagttgcaaataaaaaaaaacgaaaaaacag

SEQ ID NO: 776 - DNA, 775 bp, Brassica napus
  misc_feature (15)..(15): n is a, c, g, or t
ctggacgcctgtggnaccggtccggarwwywrsgymgargacscktsmrgcttgcctttgagtttgagcttcttataattgcttcttcttttccttctttgcctttcctctctttctcttgatcatttcaaaacttctttcttttggtaaactcttaaaaacaaccaaagacaatggaaatgaaatggctattgacctcggctttcactcaaatgtttggctactcaaaccagatcaatcaaaccagcaacagcctaagcacccgcaacaaaataaagatgatgaagaaagaggaatacccaagagggtttcaagttcctcttcactatcctaaatactccaagtctgattatgaagccatggacgatctcagccttgacttgctcctcaaacaatatggaatctccttcgaaggatctcttgaagacaagagggtctttgcaatggagtcatttctctggcctgatcagctttagggtatgtttggtgtttgaatatccaaatctctctccccacaaacgtccgatcgtatcaagtagtctcatataattaaaatgtttctgaataataaatcacgatataatatgtatcgatcaattagtagtaatcagtaatcacgtttgtgtgttatatgtatgtatgtggtatggagaagttttgaagcatgtaataatgtacacatatgtaaccaccatgagtgcatcaataacatcttttatgtattatattctaaacatgtgatctatggacttatgattatcaaatcatcacatga

SEQ ID NO: 777 - DNA, 530 bp, Brassica oleracea
accaccctcctttatcatcttccttcacctccccctttccccctttccgtacaacacaacaatggcgagaggctcttcccagtcccaacaatcaacctccaccgcttcctcaaccgccaggcccggtctggccgctccccgtggatccgccgccgctacggcgggcatgcgtcgtcgcaggctcggtggcggtgggagcgcgtcatcagggggcggatccgtcgctggatcaggatcgagcaacatgctgagattctacacagacgaagctcctggactgaagatttcacctaccgtcgtcctcatcatgagtctctgcttcatcggctttgtcaccgctcttcacgtcttcggaaaactctacctccacaagtccggatccaaagcttagatccggatccggatctcttcttccctatggtctctcttgtttctttttacttgtgttcttttttggtttcttgtttcttgaatcttgatgatccgtgtaaaaccgcttaactttgaataaaacatgtttacttacgaat

SEQ ID NO: 778 - DNA, 496 bp, Brassica rapa
gattctattatacaccaccaccaaagatttgacttaaaaaaaaaaaacattttgtctcttctccgtccaatacaagaagaatggctaaaggctcttcccagtcccagcaatcaacctccaccgcctcctcagcctcccgacccggtctggctgctcctcgtggatccgccgccgctacggctgggatgcgtcgccgcaagctcggtggcggtggaggcgcatcggcagggggaggatccggtgcaggaggaggatcgaacaacatgctgagattctacacggatgaagctccaggtttgaagatatcaccgacggttgttctcataatgagtctctgtttcatcggttttgtcaccgctcttcacgtctttggaaagctctaccttcacaagtccggatccaaagcttagatcttgtcatcttgatcttctccaatgtatgttgctgagttttcttttttttttgtccgtcttttgtttccttttttggtcgatct

SEQ ID NO: 779 - DNA, 510 bp, Brassica rapa
cttccttcacctctctctttacccttttccgtacaacacaacaatggcgagaggctcttcccagtcccaacaatcaacctccaccgcttcatcaaccgccaggcccggtctggccgctccccgtggatccgccgccgctacggccggcatgcgtcgtcgcaggctcggtggcggtggaggcgcgtcatcagggggcggatccgtcgctggatcaggatcgagcaacatgctgagattctacacagatgaagctcctggtttgaagatttcacctaccgtcgtcctcatcatgagtctctgcttcatcggctttgtcaccgctcttcacgtcttcggaaaactctacctccacaagtccggatccaaagcttagatccggatccggatctcttcttccgtatgttgaatcagtggtcgcttcttgtttctttttttggttcttgtttcttgaatcttgatgatccgtgtaaaaccgcttaactttgaataaaacatgtttacttatggagt

SEQ ID NO: 780 - DNA, 746 bp, Brassica napus
cgcccaaaaaaagtcgttgggagtattctatataatgtagttttatatacatactacaactcccacgtctcttcctgttcttcatcaacattctattatacaccactaccaaagatttgacttttgatttacaatttttgtctcttttccgtccaacacaagaacatggctaaaggctcttcccagtcccaacaatcaacctccaccgccycctcagcctcccgtcccggtctggctgctcctcgtggatccgccgccgctacggctggcatgcgtcgccgcaagcttggtggcggtggaggcgcatcggcagggggaggatccggtgcaggaggaggatcgaacaacatgctgagattctacacggatgaagctccaggtttgaagatatcaccgacggttgttctcatwatgagtctctgtttcatcggttttgtcaccgctcttcacgtctttggaaagctctaccttcacaagtccggatccaaagcttagatcttgtcatcttgatcttctccaatgtatgttgctgagttttctttttttttgtccgtcttttgtttccttttttggtcgatcttgatcttgatcttgatccatgtaagtctttaaacgttgaataaaacatgttagtttttttgtgtggaaatttgtgttttaagtcttgaaatgtatatagtacgaattatattatcttaattgtgtaaagattcttcctaatcaattgctctctgttttcaaactta

SEQ ID NO: 781 - DNA, 465 bp, Brassica napus
acaacaatggcgagaggctcttcccagtcccaacaatcaacctccaccgcttcatcaaccgccaggcccggtctggccgctccccgtggatccgccgccgctacggccggcatgcgtcgtcgcaggctcggtggcggtggaggcgcgtcatcagggggcggatccgtcgctggatcaggatcgagcaacatgctgaggttctacactgatgaagctcctggtttgaagatttcacctaccgtcgtcctcatcatgagtctctgcttcatcggctttgtcaccgctcttcacgtcttcggaaaactctacctccacaagtccggatccaaagcttagatccggatccggatcttttcttccgtttgttgaatcagtggtcgcttcttgtttctttttttggtttcttgtttcttgaatcttgatgatccgtgtaaaaccgcttaactttgaataaaacatgtttac

SEQ ID NO: 782 - DNA, 401 bp, Raphanus sativus
ggaggatycgtgggtggkggaggatcgagcaacatgctgaggttctacacggatgaagctcctggtttgaagatatcacyracggttgttctcattatgagyctatgcttcatcggttttgtcaccgctcttcacgtctttggaaagctctaccttcacaaatccggmtccaaagcttagatcttgtcatcttgatcttctccaatgtatgttgctgagttttctttttgtatgtcttttgtttcctttttttggtcgatcttgatcttgatcttgatccatgtaagtctttaaacgttgaataaaacatgttagtttttgtttgtatgtgtttaactacataaacttgaaatgtatattacaatttatattatcttaattgtgtaaagattaatcttcac

SEQ ID NO: 783 - DNA, 460 bp, Thellungiella halophila
accgcctcatcaaccgctcggcccggtctggccgctccccgtggatccgccgccgctacggccggcatgcgtcgccgtagactcggcggtggcggaggattatcgtcaggaggcggatcggcggctggatcaggatcgagcaacatgctgagattctacaccgatgaagctccagggctgaagatctcaccgaccgtcgtcctcattatgagcctctgtttcatcggctttgttacggctcttcacgtcttcggaaaactctacctccacaaatccggatccaaagcatagatccggatctggatctttttctcctccgtatgtttaatcggtgcatggttgcttggtttttttttgtttttttttttttgactttttcttgtattctgcttcctctttttggttttcctttgttggcgatctaaatcgctaaacgttgaataaaacatgttacttttgg

SEQ ID NO: 784 - DNA, 1030 bp, Brassica rapa
ggtcgctcactctttattaacaacatcatttaccccctttccctctcgcctttctctttccatttcactgtttcaagttgaaaccaaagactcttcactttctccctacaatagactcctacacctactctttctctctcttgattctagctacaaaaacgttatagttcccatcacaatacacccaaaaatgcaattttcaagaaactcaatccttagacaactaagcagaaaagaaggttggaggtcggcttctagaaggtggacatccggagatagctcaacggccttcgccgacgacacaagcggtggtgctggcggttactcttcaatggagggcctgtatggggtttattccggtgaagatccggcggcgagaaggaaaagagtgatggttgtggtggatgaggcttcaaggtccaaacatgctatgatgtgggctttgacgcacttgactaacaaaggagacttgatgactcttcttcatgttgtgtctcctcatgatgaagcttcttcttctttggttcagtcacttggttctctttgcaaagcttgtaaacccgaggtggatgtggaggcgttggtgattcaaggaccaaagttagcaactgtactcagccaagtgaagaaacttgaagtcactgttcttgttttgggtcagaagaaatctgcaccattcatctcctgcttatgtggacccagtagatcagaggagctcgtgaatcgatgtatcaatggtgcagattgtttgacgattggtgtgaggaaacaaagcaacggtgttagtggctacctgattaacacacgatggcagaagaacttctggcttctggcctaatcgcaatttctaatcttagcagccgtagaatggttccatcagttggtgttaattttagtgtaataaactatggatctctttcttgtcccatgttgaacataactttgtcttatgtccggtaagaaattaaagtttaactatttgtaattgtatcccacttgatcgattccaccttattgatactcttatgct

SEQ ID NO: 785 - DNA, 551 bp, Brassica napus
ggcttctttctctttccatttcgctgtgtcaagtttaaaccaaagcctcttcacttttaccctataatagtctcctactacctacactttctcgctcttgatccacactacttacaaaatgcaattttcaagaaactcaatacttagacaacgaagcagaaaagaaggttggaggtcggcttctaaaaggtggacatccggagatagttcaacggccttcaccgacgcaacaagctgtggtggtggttactcttcaatggagggtctttatggggtctactcaaatggagatacagcaaccagaagcaagagggtgatggttgtggtggatgagacttcgaggtcggaacatgccatgatgtgggctttgacgcatttgactaataagggagatttgatgactcttctccacgttgtgtctcctcatgatgaagcttctccttctttggttcaatcacttggttctctttgcaaagcttgtaaacccgaggtggatgtggaggcgttggtggttcaaggaccaaagttagcaactatactcagccaagtga

SEQ ID NO: 786 - protein, 188 aa, Brassica rapa
MSGGGNTIPSVGGAGCGGGGGSSSGGGGSSGGGGGPCGACKFLRRKCVPGCIFAPYFDSEQGSAYFAAVHKVFGASNVSKLLLHIPVHRRADAVVTICYEAQARIRDPIYGCVAHIFALQQQVVNLQAEVSYLQSHLASLELPQPQTRPPPITQPQPLFFTPPPPLFITDFAASVSPYDLATIVDPPT

SEQ ID NO: 787 - protein, 165 aa, Brassica napus
MSGGGNTITSVGGGGCGGGSSSGGGGSSGGGGGPCGACKFLRRKCVPGCIFAPYFDSEQGSAYFAAVHKVFGASNVSKLLLHIPVHRRADAVVTICYEAQARIRDPIYGCVANIFALQQQVVNLQAEVSYLQAHLASLELPQPQTRPPPLTQPQPLFFTPPRLFP

SEQ ID NO: 788 - protein, 191 aa, Raphanus sativus
MSGGGNTITAVGSGGGGGGSSSGGGGGPCGACKFLRRKCVPGCIFAPYFDSEQGSAYFAAVHKVFGASDVSKLLLHIPVHRRSDAVVTICYEAQARIRDPIYGCVAHIFALQQQVVNLQAEVSYLQAHLASLELPQPQTRPPPLTQPQPLFFTQPPPLSLTDLPASASPLPSTYDLASIFDQSTPSWATQQ

SEQ ID NO: 789 - protein, 176 aa, Brassica oleracea
MVKLATAREIRTYGPRLGRSRAEYINAGLYLFATVVLIGGFTATGFSWEPRSGLVLILLALALITAVNVHDLVAHLAGIDYRLKLMEYDLQLGLVEFAVPLVQIAGSVVFFLGILFVFNQAETKHGNSGREKHALNMLIAGPLLWVIGSIHNSCQIYERVDSHVQILQQCVHIPFL

SEQ ID NO: 790 - protein, 167 aa, Brassica rapa
  misc_feature (147)..(147): Xaa can be any naturally occurring amino acid
MRISCNGCRVLRKGCNQDCTIRPCLQWIKSADSQANATLFLAKFYGRAGLLNLIESGPDHLRPAIFRSLLYEACGRIVNPVDGSVGLMWSGNWAQCQAAVDAILNGLPITHTPLPSASSSHQIIPPHRTYDIRHVAKDPTTGGDSSXSLALAPRVNGNKAKTQTGRL

SEQ ID NO: 791 - protein, 237 aa, Brassica napus
  misc_feature (176)..(176): Xaa can be any naturally occurring amino acid
MRISCNGCRVLRKGCNQDCTIRPCLQWIKSADSQANATLFLAKFYGRAGLLNLIESGPDHLRPAIFRSLLYEACGRIVNPVDGSVGLMWSGNWAQCQAAVDAILNGLPITHTPLPSASSSHQIIPPHRTYDIRHVAKDPTTGGDSSESLALAPRVNGNKAKTQTGRLKRLAETVDXQLGECSHDTWQLQCSGATHGYGQLALENVANRREAPLNQSSNLGRDDQVDTNEVGLELRLG

SEQ ID NO: 792 - protein, 424 aa, Brassica napus
  misc_feature (319)..(319): Xaa can be any naturally occurring amino acid
  misc_feature (332)..(332): Xaa can be any naturally occurring amino acid
MATNRFICDVCKKGFQREQNLQLHRRGHNLPWKLKQKSTKEVKRKVYLCPEPTCVHHDPSRALGDLTGIKKHYYRKHGEKKWKCDKCSKRYAVQSDWKAHSKTCGTKEYRCDCGTIFSRRDSYITHRAFCDALIQETARNPTLSFTSMEAASSGAGSGGLYGRLDGGRTLSHHHLSGHPNSGFSPLAGYNLNIASSENSRHFVPQTSNPNFLIQSSQGMLTVPNNNDQSFMNHHGLNQFDPVNNINSKSSTNNSFFNLGFFQENIKNSETSLPSLYSSDVLVNHPEESLNVGSNVSATALLQKATQMGSITSNDPSALXRGLASSSSNDFGXGQIMGNDNNGNLQGLMNSLVAVNGGGAGGSGGNIFDVHFGNNGNMSGSDKLTLDFLGVGGMVRNVNRGRGRGDVSLDGELKFSEQNHPFGRS

SEQ ID NO: 793 - protein, 322 aa, Brassica napus
HIHYQRGKSKNMFKLSLVLVFLIAFSGIDASPIKYHNPSCSGNMSATDVDLVHFAMNLEFTEAEFFLKASTGKGLDAFNATLAKGGPPPIGAKKANLDPITNRIIEEFGYQEIGHLRAIADMTGGIPRPLLNLTRENFAMFMDRAVGRRSNPRFDPYANSLNYLLASYYIPYVGLTGYVGAIPYLVYFNIKRLVAGLLGVESGQDGVIRTLLYERQNEKVEEYGGVTVAELTNEISNLRNELGMCGIKDEGLCVPLWLGAENRTTSNILSADPYSLSYDRTPQEILRVMYGTGNERRPGGFWPCGANGRIARMFLDERYHGN

SEQ ID NO: 794 - protein, 226 aa, Brassica napus
KKFLPANFTVVLFHYDGNMDKWWDLEWSSKAIHIVAQNQTKWWFAKRFLHPDVVSIYDYVFLWDEDLGVENFTPERYLKIVKVEGLEISQPALDRNSTEIHHKITLRSKTKKFHRRVYINRGTKKCSNTSEDPPCTGFVEGMAPVFSRAAWFCTWNLIQNDLVHGWGMDMKLGYCAQGDRKMKVGIVDREYIFHQGIQTLGESVQSDKKTRARDVRTNRHGHTTFD

SEQ ID NO: 795 - protein, 189 aa, Brassica oleracea
SGWKVKPFLALICTALLIFWYRTTNIQFEETELEEADYPFDMAMESEPVDAKLKGLPRGILQPRSDLELKPLWSSNSLRAKGVEMTNRNLLAVPVGIKQKGNVDAMVKKFLPANFTVVLFHYDGNMDKWWDLEWSSKAIHIVAQNQTKWWFAKRFLHPDVVSIYDYVFLWDEDLGVENFTPERYLKIVK

SEQ ID NO: 796 - protein, 364 aa, Brassica napus
MVKSRDMLPSLAMVLVQIGYAGMNITSKMAMEAGMKPLILVAYRQIFASIATLPVAFFLERKTIPKITIRVLVQAFFCSITGVTGNQVLYFIGLQNSSPTIACALTNLLPAVTFLLAAIFRQEAVGIRKVSGQAKVIGTVVCVAGAMLLSFYHGHTIGIGESKIHWTYAQNITTHGSDSAGSNFFLGPFLIMAAAVSCAGWFIIQTKMSETFAAPYTSTLLMCLMGSIQCGVVALISDHKLADWSLSSPLRLISALYAGVVASALAFCLMSWAINIKGPLYVSVFSPLVLVIVAVFSWTLLEEKLYTGTFMGSALVVIGLYGVLWGKDREMNEKEDEVEIQKMAKQQPTVKRDINEDIESRLSS

SEQ ID NO: 797 - protein, 177 aa, Brassica rapa
MELPPKVKNILLLDSEGKRIAAKYYSGDWPTNTEKEAFEKAVFSKTQKTNARTEVEVTALENNIIVYKFVQDLHFFVTGGEEENELVLASVLQGLFDAVNLLLRGNVDKREALDNLDLIFLCFDEIIDGGIVLETDANVIAEKAGINSIDPNAPLSEQTISQALATAREHLTRSLMK

SEQ ID NO: 798 - protein, 177 aa, Brassica napus
MELPPKVKNILLLDSEGKRIAAKYYSGDWPTNTAKEAFEKAVFSKTQKTNARTEVEVTALENNIIVYKFVQDLHFFVTGGEEENELILASVLQGLFDAVNLLLRGNADKREALDNLDLIFLCFDEIIDGGIVLETDANVIAEKAGINSIDPNAPLSEQTISQALATAREHLTRSLMK

SEQ ID NO: 799 - protein, 278 aa, Brassica napus
MKSRSCAANQYSEATGDQVLRGVNYASAAAGILPDTGGNFVGRIPFDQQIHNFETTLNQVASKSGGAVTIADSVARSLFFIGMGSNDYLNNYLMPNFPTRNQYNAQQFGDLLVQQYTNQLTRLYNLGGRKFIVSGLGRMGCIPSILAQGTDGKCSEEVNQLVLPFNTNVKTMITNLNQNLPDAKFIYLDTANMVQDITTNPAVYGFTTLDKGCCGIGRNRGQITCLPFETPCPNREQYLFWDAFHPTEKVNLIMAKKAFAGDRTVAFPINIQELASLN

SEQ ID NO: 800 - protein, 384 aa, Brassica napus
MAFHFRRLCMSSALLVVVLQILHGVSGQLVVVEDPVSASPPPLVEQDGSDGIVPALFVFGDSLIDNGNNNNIPSFAKANYFPYGIDFNGGPTGRFCNGLTMVDGIAQLLGLPLIPAYSEATGDQVLRGVNYASAAAGILPDTGGNFVGRIPFDQQIHNFETTLNQVASKSGGAVTIADSVARSLFFIGMGSNDYLNNYLMPNFPTRNQYNAQQFGDLLVQQYTNQLTRLYNLGGRKFIVSGLGRMGCIPSILAQGTDGKCSEEVNQLVLPFNTNVKTMITNLNQNLPDAKFIYLDTANMVQDITTNPAVYGFTTLDKGCCGIGRNRGQITCLPFETPCPNREQYLFWDAFHPTEKVNLIMAKKAFAGDRTVAFPINIQELASLN

SEQ ID NO: 801 - protein, 272 aa, Brassica oleracea
MGKRRGVSAVNVVFGWLRHQSKMVKIPLGIILPLILVVFLRFTVKNHNHFFVASELIHAAGIIILIYKLTRQKTCSGLSLKSQEVTAVFLAVRLICSISMEGDIHTVLDFATLVSTLWVIYMIRFKLKASYVKTLDNCHHYYVLVPSAILAFIIHPSTRYTYINRVMWAFCVYLESVSVLPQLRLMQNAQIIEPFTAHYVFALGIARFLACAHWLIQVFETRGRYLWLIGAGYFWFPMALLAEAVQTFILADFCYYYVKSAMEGQLVLKMPV

SEQ ID NO: 802 - protein, 188 aa, Brassica rapa
MGKRRGVSAVNVVFGWLRKQSKKVKIALGVILSLLPVVFLKFTVKNYNHFFIASELIHAAGIIILIYKLTRQKTCSGLSLKSQEVTAVFLAVRLICSINMEGDIHTVLDFATLVSTLWVIYMIRFTLKASYIKSPDTCHNYYVLVPSAILALIIHPKTSYNYIHSVMWAFCVYSESVSVLPQLRLMQN

SEQ ID NO: 803 - protein, 200 aa, Brassica rapa
MGKRRGVSAVNVVFGWLRHQSKMVKIPLGIILSLILVVFLRFTVKNHNHFFVASELIHAAGIIILIYKLTRQKTCSGLSLKSQEVTAVFLAVRLICSISMEGDIHTVLDFATLVSTLWVIYMIRFKLKASYVKTLDNCHHYYVLVPSAILAFIIHPSTRYTYINRVMWAFCVYLESVSVLPQLRLMQNAQIIEPFTAHYV

SEQ ID NO: 804 - protein, 167 aa, Brassica napus
MEGDIHTVLDFATLVSTLWVIYMIRFTLKASYIKTLDTGHNYHVLVPSAILALIIHPKMSYNYIHSVMWAFCVYAESVSVLPQLRLMQNAQIIEPFTAHYVFALGIARFLACAHWLIQVFETRGRYLWLIGAGYFWFPVALVAELIQTFILADFCYYYVKSVMEGQL

SEQ ID NO: 805 - protein, 208 aa, Raphanus sativus
MGKRRGVSAVNVVFGWLRQQSKMVKIALGVILSLILVVFLRFTVKNHNHFFVASELIHAAGIIILIYKLTRQKTCSGLSLKSQEVTAVFLAVRLICSINMEGDIHTVLDFATLVSTLWVIYMIRFKLKASYVKTLDNFHHYYVLVPSAILAFIIHPSSRYTYINRVMWAFCVYSESVSVLPQLRLMQNAQIIEPFTAHYVFALGIARF

SEQ ID NO: 806 - protein, 173 aa, Brassica napus
MAASVDPLVVGRVIGDVLDMYIPTANMSVYVGPKHITNGCEIKPSAAVKPPKVNISGNPDELYTLVMTDPDAPSPSEPNMREWVHWIVVDIPGGTNPSKGKEILPYMEPKPPVGIHRYIFVLFRQISPVGLMVQQPPSRANFSTRMFAGHLDLGLPVATVYFNAQKEPASGRR

SEQ ID NO: 807 - protein, 173 aa, Raphanus sativus
MAASVDPLVVGRVIGDVLDMYIPTANMSVYVGPKHITNGCQIKPSAAVNPPRVTISGNSDELYTLVMTDPDAPSPSEPNMREWVHWIVVDIPGGTNPSKGKEILPYTEPRPPVGIHRYILVLFRQRSPVGLMVQLPPSRANFSTRMFAGHLDLGLPVATVYFNAQKEPASRRR

SEQ ID NO: 808 - protein, 232 aa, Brassica oleracea
TQHLLTASGKKRNDRDDEDGVSTVAKKSSLMACEADPAVALASIRHEFGEHGGVNMSIEASATFTVMEPDTMRRMFAGELGPENDFFVYSRHFNPTVLNLSRQMAALEGTQAAYCTSSGMAAISSVLLQLCSSGGHVVASKTLYGGTHALLSHFLPRTCNITTSFVNITDHGAVADAIVEGKTQVLYFESMANPTLTVADIPELSRIAHEKGVMVVVDNTFTPMVLSPAKFG

SEQ ID NO: 809 - protein, 249 aa, Brassica rapa
  misc_feature (186)..(186): Xaa can be any naturally occurring amino acid
MAHILNTQHLLTTSGKKRNDRDDEDGVSTVAKKSSLMACEADPAVALASIRHEFGEHGGVNMSIEASATFTVMEPDTMRRMFAGELGPENDFFVYSRHFNPTVLNLSRQMAALEGTQAAYCTSSGMAAISSVLLQLCSSGGHVVASKTLYGGTHALLSHFLPRTCNITTSFVDITDHGAVADAIVXGRTQVLYFESMANPTLTVADTPELSRIAHEKGVAVVVDNTFTPWCCLRPSLEQMWWFTVSPVH

SEQ ID NO: 810 - protein, 441 aa, Brassica napus
MAHILNTQHLLTTSGKKRNDRDDEDGVSTVAKKSSLMACEADPAVALASIRHEFGEHGGVNMSIEASATFTVMEPDTMRRMFAGELGPENDFFVYSRHFNPTVLNLSRQMAALEGTQAAYCTSSGMAAISSVLLQLCSSGGHVVASKTLYGGTHALLSHFLPRTCNITTSFVDITDHGAVADAIVEGRTQVLYFESMANPTLTVADTPELSRIAHEKGVAVVVDNTFTPMVLSPAKFGADVVVHSISKFISGGADIIAGAVCGSEKLVKGMMDLRGGSLMLLGPTMNAKVAFELSERIPHLGLRMKEHSRRAQVYAERMRELGMKVIYPGLTDHPQHKVATEMVNREYGYGGLLSIDMETEERANKLMTYLQNATQFGLMAVSLGYYETLMSCSGSSTSSELDPSQKAAAGISPGLIRMSVGYAGTLEQKWTQFEKAFIRM

SEQ ID NO: 811 - protein, 68 aa, Malus x domestica
MTTSRRLADRKVERFEKNITKRGAVPETTAKKGKDYPVGPILLGFFVFVVIGSSLFQIIRTATSGGMA

SEQ ID NO: 812 - protein, 68 aa, Malus x domestica
MTTSRRLADRKVEKFEKNITKRGAVPETTAKKGKDYPVGPILLGFFIFVVIGSSLFQIIRTATSGGMA

SEQ ID NO: 813 - protein, 68 aa, Persea americana
MTTSRRLADRKVAKFQKNITKRGSVPETTVKKGNDYPVGPIVLGFFVFVVIGSSLFQIIRTATSGGAA

SEQ ID NO: 814 - protein, 51 aa, Brassica juncea
LADRKIEKFDKNITKRGFVPETTTKKGKDYPVGPILLGFFVFVVIGSCEYS

SEQ ID NO: 815 - protein, 62 aa, Brassica juncea
LADRKIEKFDKNITKRGFVPETTTKKGKDYPVGPILLGFFVFVVIGSSLFQIIRTATSGGMA

SEQ ID NO: 816 - protein, 68 aa, Brassica juncea
MTTSKRLADRKIEKFDKNITKRGFVPETTTKKGKDYPVGPILLGFFVFVVIGSSLFQIIRTATSGGMS

SEQ ID NO: 817 - protein, 68 aa, Brassica rapa
  misc_feature (54)..(54): Xaa can be any naturally occurring amino acid
MTTSKRLADRKIEKFDKNITKRGFVPETTTKKGKDYPVGPILLGFFVFVVIGSXLFQIIRTATSGGMA

SEQ ID NO: 818 - protein, 68 aa, Phaseolus vulgaris
MTTSRRFADRKVEKFEKNITKRGFVPDTTSKKGKDYPVGPLLLGFFVFVVIGSSLFQIIRTATSGGMA

SEQ ID NO: 819 - protein, 68 aa, Brachypodium distachyon
MTTSRRLADRKTAKFQKNITKRGSVPETTVKKGNDYPVGPIVLGFFIFVVIGSSLFQIIRTATSGGMA

SEQ ID NO: 820 - protein, 68 aa, Manihot esculenta
MTTSRRLADRKVEKFEKNITKRGAVPETTTKKGKDYPVGPVLLGFFVFVVIGSSLFQIIRTATSGGMA

SEQ ID NO: 821 - protein, 68 aa, Manihot esculenta
MTTSRRLADRKVERFEKNITKRGAVPETTTKKGNDYPVGPVLLGFFIFVVIGSSLFQIIRTATSGGMA

SEQ ID NO: 822 - protein, 68 aa, Ricinus communis
MTTSRRLADRKVERFEKNITKRGTVPETTTKKGKDYPVGPLLLGFFIFVVIGSSLFQIIRTATSGGMA

SEQ ID NO: 823 - protein, 68 aa, Centaurea maculosa
MTTSRRLADRKVEKFDKNILRRGSVPETFAKKGKSYPVGPLMLGFFVFVVIGSSLFQIIRTATSGGMA

SEQ ID NO: 824 - protein, 68 aa, Centaurea maculosa
MTTSKRLADRKVEKFEKNIKKRGSVPETTTKKKDSYPVGPIVLGFFIFVVIGSSLFQIIRTATSGGMA

SEQ ID NO: 825 - protein, 68 aa, Citrus sinensis
MTTSKRLAVRKVDKFEKNIMKRGAVPETTTKKGKDYPVGPVLLGFFVFVVIGSSLFQIIRTATSGGMA

SEQ ID NO: 826 - protein, 68 aa, Citrus sinensis; identical to SEQ ID NO: 825

SEQ ID NO: 827 - protein, 68 aa, Coffea arabica
MTTSRRLADRKVEKFEKNITRRGAVPETSTKKGSNYPVGPILLGFFVFVVIGSSIFQIIRTATSGGMA

SEQ ID NO: 828 - protein, 68 aa, Gossypium hirsutum
MTTSRRLAERKVEKFQKNITKRGAVPETTTKKGKDYPVGPLLLGFFIFVVIGSSLFQIIRTATSGGMA

SEQ ID NO: 829 - protein, 68 aa, Mesembryanthemum crystallinum
MTTSRRLADRKSEKFQKNITRRGSVPETTVKKGADYPVGPVLLGFFVFVVIGSSLFQIIRTATSGGMA

SEQ ID NO: 830 - protein, 68 aa, Ipomoea batatas
MTTSRRLASRKVEKFEKNITKRGFVPESTTKKGNNYPVGPILLGFFVFVVIGSSLFQIIRTATSGGMA

SEQ ID NO: 831 - protein, 68 aa, Lactuca sativa
MTTSKRLADRKVERFEKNIKKRGSVPETTTKKKDSYPVGPIVLGFFIFVVIGSSLFQIIRTATSGGMA

SEQ ID NO: 832 - protein, 68 aa, Lactuca sativa; identical to SEQ ID NO: 831

SEQ ID NO: 833 - protein, 68 aa, Lactuca sativa; identical to SEQ ID NO: 831

SEQ ID NO: 834 - protein, 68 aa, Lactuca sativa; identical to SEQ ID NO: 831

SEQ ID NO: 835 - protein, 68 aa, Lotus japonicus
MTTSRRLADRKVEKFEKNITKRGFVPETTAKKGKDYPVGPVLLGFFVFVVIGSSLFQIIRTATSGGLA

SEQ ID NO: 836 - protein, 68 aa, Medicago sativa
MTTSKRLAVRKVEKFEKNITKRGSVPETTVKKGNDYPVGPVLLGFFVFVVIGSSLFQIIRTATSGGMA

SEQ ID NO: 837 - protein, 68 aa, Capsicum annuum
MTTSRRLADRKVERFEKNITKRGAVPETTAKKGNQYPVGPILLGFFVFVVIGSSLFQIIRTATSGGMA

SEQ ID NO: 838 - protein, 68 aa, Vinca minor
MTTSRRLADRKIEKFEKNITKRGSVPETTAKKGSNYPVGPILLGFFIFVVIGSSLFQIIRTATSGGMA

SEQ ID NO: 839 - protein, 68 aa, Petunia x hybrida
MTTSRRLADRKIERFEKNITKRGAVPETTAKKGNQYPVGPILLGFFVFVVIGSSLFQIIRTATSGGMA

SEQ ID NO: 840 - protein, 69 aa, Solanum tuberosum
MTTSRRLADRKVERFEKNITKRGAVPETTAKKGSQYPVGPILLGFFVFVVIGSSLFQIIRTATSGGGMA

SEQ ID NO: 841 - protein, 68 aa, Raphanus sativus
MTTSKRLADRKIERFDKNITKRGFVPETTTKKGKDYPVGPILLGFFVFVVIGSSLFQIIRTATSKGMA

SEQ ID NO: 842 - protein, 68 aa, Raphanus sativus; identical to SEQ ID NO: 841

SEQ ID NO: 843 - protein, 68 aa, Raphanus sativus
MTTSKRLADRKIEKFDKNITKRGFVPETTTKKGKDYPVGPILLGFFVFVVIGSSLFQIIRTATSKGMA

SEQ ID NO: 844 - protein, 68 aa, Rosa hybrid cultivar
MTTSRRLADRKVERFEKNITKRGAVPETTAKKGKDYPVGPILLGFFIFVVVGSSLFQIIRTATTGGMA

SEQ ID NO: 845 - protein, 68 aa, Carthamus tinctorius
MTTSRRLADRKVEKFDKNIVRRGSVPETSGKKGKSYPVGPVMLGFFVFVVIGSSLFQIIRTATSGGMA

SEQ ID NO: 846 - protein, 68 aa, Carthamus tinctorius; identical to SEQ ID NO: 831

SEQ ID NO: 847 - protein, 68 aa, Carthamus tinctorius; identical to SEQ ID NO: 824

SEQ ID NO: 848 - protein, 68 aa, Glycine max
MTTSRRLADRKVEKFEKNITKRGFVPDTTTKKGKDYPVGPVLLGFFVFVVIGSSLFQIIRTATSGGMA

SEQ ID NO: 849 - protein, 68 aa, Glycine max; identical to SEQ ID NO: 848

SEQ ID NO: 850 - protein, 67 aa, Euphorbia antiquorum
MTTSRRLADRKVEKFEKNIMKRGFVPETSTKKGKDYPVGPVLLGFFIFVVIGSSLFQIIRTATSGGY

SEQ ID NO: 851 - protein, 68 aa, Fragaria x ananassa
MTTSRRLADRKVERFEKNITKRGAVPETTAKKGKDYPVGPILLGFFIFVVIGSSLFQIIRTATTGGMA

SEQ ID NO: 852 - protein, 68 aa, Nicotiana tabacum; identical to SEQ ID NO: 839

SEQ ID NO: 853 - protein, 362 aa, Raphanus sativus
MSKRALPKSPPKLVLLPALLILSSTCLFGILTNLQTLSYLFRPLWDKPPPPFRRIPHYYAENVSMSHLCHLHGWTPRTSPRRVFDAIIFSNELDLLEVRWQELGPYVSKFVILESNTTFTGIPKPLFFDSAKARFAFAEGKIVHGVFPGQKRSSLQEEDPFLLEGRQRVAMNWLLREANVSDGDAVIMSDADEIPSPHTVKLLQWCDGIPDVMHLEMRDYMYSFEFPVDYSSWRASVHLYSRKWTHYRHSRQTDLILSDAGWHCSFCFRRLSEFVFKMKGYSHADRVRRKEFLDYSRIQKRICKGYDLFDMLPEEYSFRDLISKIGPIPPSASAVHLPAFLIQNAARFRFLLPGGCLREPLS

SEQ ID NO: 854 - protein, 198 aa, Raphanus sativus
  misc_feature (171)..(171): Xaa can be any naturally occurring amino acid
LEGRQRVAMNWLLREANVSDGDAVIMSDADEIPSPHTVKLLQWCDGIPDVMHLEMRDYMYSFEFPVDYSSWRASVHLYSRKWTHYRHSRQTDLILSDAGWHCSFCFRRLSEFVFKMKGYSHADRVRRKEFLDYSRIQKHICKGYDLFDMLPEEYSFKDLISKIGPIPPSAXAVHLPAFLIQNAPRFRFLLPGGCLREP

SEQ ID NO: 855 - protein, 232 aa, Brassica oleracea
  misc_feature (183)..(183): Xaa can be any naturally occurring amino acid
MSIPQAKMELRPLGNTGLKVSSVGFGASPLGSVFGPVAEVDAVATVREAFRQGINFFDTSPYYGGTLSEKMLGKGLKALQVPRSDYIVATKCGRYEEGFDFSAERVTKSIDESLERLQLDYVDILHCHDIEFGSLDQIVSETIPALQKLKREGKTRFIGITGLPLSIFTYVLDRVPPGTVDVXLSYCHYGVNDSTLVDLIPYLKGKGVGVISASPLAMGLLTEQGGPEWHPA

SEQ ID NO: 856 - protein, 323 aa, Brassica rapa
MSIPQAKMELRPLGNTGLKVSSIGFGASPLGSVFGPVAEVDAVATVREAFRQGINFFDTSPYYGGTLSEKMLGKGLKALQVPRSDYIVATKCGRYEEGFDFSAERVTKSIDESLERLQLDYVDILHCHDIEFGSLDQIVSETIPALQKLKQEGKTRFIGITGLPLSIFTYVLDRVPPGTVDVILSYCHYGVNDSTLVDLIPYLKGKGVGVISASPLAMGLLTEQGGPEWHPASPELKSACKAAAAHCKSKGKKITKLALQYSLANKEISSVLVGMSSVSQVEENVAAVKELEDLGMDQETLSEVEAILEPVKNQTWPSGVDQK

SEQ ID NO: 857 - protein, 274 aa, Brassica napus
MSIPQAKMELRPLGNTGLKVSSVGFGASPLGSVFGPVAEVDAVATVREAFRQGINFFDTSPYYGGTLSEKMLGKGLKALQVPRSDYIVATKCGRYEEGFDFSAERVTKSIDESLERLQLDYVDILHCHDIEFGSLDQIVSETIPALQKLKREGKTRFIGITGLPLDIFTYVLDRVPPGTVDVILSYCHYGVNDSTLVDLIPYLKGKGVGVISASPLAMGLLTEQGGPEWHPASPELKSACKAAAAHCKSKGKKITKLALQYSLGNRRFHQCWLE

SEQ ID NO: 858 - protein, 323 aa, Raphanus sativus
  misc_feature (23)..(23): Xaa can be any naturally occurring amino acid
MSIPQAKMELRPLGNTGLKVSSXGFGASPLGSVFGPVAEVDAVATVSEAFRQGINFFDTSPYYGGTLSEKMLGKGLKALQVPRSDYIVATKCGRYQEGFDFSAERVTKSIDESLERLQLDYVDILHCHDIEFGSLDQIVSETIPALQKLKREGKTRFIGITGLPLSIFTYVLDRVPPGSVDVILSYCHYGVNDSTLLDLLPYLKSKGVGVISASPLAMGLLTEQGPPEWHPASPELKSACKAAAGHCKSKGKKITKLALQYSLGNKEVSSVLVGMSSVSQVEENVAAVRELEGLGMDQETLSEVEAILEPVKNQTWPSGIDQK

SEQ ID NO: 859 - protein, 323 aa, Raphanus sativus
MSIPQAKMELRPLGNTGLKVSSIGFGASPLGSVFGPVAEVDAVATVSEAFRQGINFFDTSPYYGGTLSEKMLGKGLKALQVPRNDYIVATKCGRYEEGFDFSAERVTKSIDESLERLQLDYVDILHCHDIEFGSLDQIVSETIPALQKLKREGKTRFIGITGLPLSIFTYVLDRVPPGSVDVILSYCHYGVNDSTLLDLLPYLKSKGVGVISASPLAMGLLTEQGPPEWHPASPELKSACKAAVGHCKSKGKKITKLALQYSLGNKEVSSVLVGMSSVSQVEENVAAVRELEGVGMDQETLSEVEAILEPVKNQTWPSGIDQN

SEQ ID NO: 860 - protein, 287 aa, Arabidopsis thaliana
MIVCFFCGQKQVLKQLEPWCELKDKVVLVTGASSGIGREICLDLCKAGCKIVAAARRVDRLNSLCSEINSFGAIGVQAVALELDVSSEADTIRKAVKEAWETFGKIDVLINNAGIRGNVKSSLDLSEEEWDKVFRTNLTGSWLISKYVCLLMRDAERGGSVINVSSISGLHRGLLRGGLAYACSKGGVDTMTRMMAIELAVYKIRVNSIAPGIFRSEITQGLFQKEWLKKVTEKVVPLKMQQTVDPGLTSLVRYLIHDSSQYVTGNTYIVDSGTTLPGVPIFSSLSP

SEQ ID NO: 861 - protein, 136 aa, Arabidopsis thaliana
MRDAERGGSVINVSSISGLHRGLLRGGLAYACSKGGVDTMTRMMAIELAVYKIRVNSIAPGIFRSEITQGLFQKEWLKKVTEKVVPLKMQQTVDPGLTSLVRYLIHDSSQYVTGNTYIVDSGTTLPGVPIFSSLSP

SEQ ID NO: 862 - protein, 240 aa, Brassica rapa
MRSSDEASTDFGANILMQVPLVRNMSVLTVERQPWDGDNQFGIPYPSYFHPYTSAEMLTWQDKMRRVERPHLFSFVGGPRKGLEKAAIRDELIRQCADSSRCELLKCESGGSRCHDPMTVLGVMARSRFCLQAPGDSFTRRSTFDAMLAGCIPVFFSPHTMYTQYMWYLPDDKRSYSVFMDEKNSTLIEQELSRISESDVVQMREAVIAMIPKMTYAHPNATNYNLPGAVDVALEALAMQ

SEQ ID NO: 863 - protein, 247 aa, Brassica napus
SSDEASTDFGANILMQVPLVRNMSVLTVERQPWDGDNQFGIPYPSYFHPYTSAEMLTWQDKMRSVERPHLFSFVGCPRKGLEKAAIRDELIRQCADSSRCELLKCESGGSRCHDPMTVLGVMARSRFCLQAPGDSFTRRSTFDAMLAGCIPVFFSPHTMYTQYMWYLPDDKRSYSVFMDEKNSTLIEQELSRISESEVVHMREAVIAMIPKMTYAHPNATNYDLPDAVDVALEALAMQAKTKVVYSL

SEQ ID NO: 864 - protein, 594 aa, Brassica napus
  misc_feature (66)..(66): Xaa can be any naturally occurring amino acid
  misc_feature (92)..(92): Xaa can be any naturally occurring amino acid
MDVVKIDYNYKGDNALKELERITSKAAEVQDNILCGILEQNKDTQYLSKYMKGSKDVLEFKRSVPXITYKDVCPYIQRIANGEDSSLITGHXITEILCSSGTSGGEPKLMPTISEDLDRRTFVYNLINPIANKYLEGLDKGKTMYLNFVKAETSTPCGLPIRTVLTSYYKSKHFQCRPYDPFNDLTSPIQTILCEDSNQSMYCQLLAALIHRHKVMRLGAVFASAFLRAISYLERKWSQLCQDIRTGHLSPMITDPGCQTAMSSLLASPNPDLADEIEEICGRPSWKGILCQLWPQAKFIEAVVTGSMAQYIPALEFFSQGKIPLVCPMYASSETYFGVNVMPLSKPSDVVFTLLPNMCYFEFIPLGKNGTLSFDVEDEEVVPCDKVVDLVDVKLGRYYELVVTTFAGLYRYRIGDVLQVAGFYNKAPQFKFICRRNVVLSIDLDKTNEEDLHRSITLAKKKLENKAFLAEYTSYADTSSVPGHYVLFWEIQWLEPDDEEEKLLMEECCIAVEEELDYIYRQCRKRDRSVGPLEIRVVKAGTFEKLMDMIISQGGSLNQYKTPRCVKSNSAMLKLLDGHVTGSFFSPRDPTWSP

SEQ ID NO: 865 - protein, 375 aa, Brassica napus
EGFNNEVLRKGCEELGLKVKNIPRNASKDHYCGFCSLRCKKGQMQGTSETWLVDLVESGNGLILPGCRAMEVLYECESGNKKKTSTGIAFAFGEDIYVVESRATVVACGALRTPHLLKRSGLKNGNIGRNLCLHPVVMAWGWFPEEEKWPEKKKKSYEGGIMTAMSSVVNAEAKTTYGETVIQTPSLHPGMFSGVIPWTSSNDFKTRMLKFSRTAHVFTLLRDKGTGTINSKSYIDYNLNDEDEESLKKGLGSVLNILIAAGAEEIGTHNSEGKSLNVRTASAVEIKRFVREESSKSLKDLSGQICSAHQMGSCRMGIRPEESAVKPTGETWEVEGLFVADTSVFPTALGVNPMVTVQSIAYCIGLNVVGALKKK

SEQ ID NO: 866 - protein, 184 aa, Brassica oleracea
LHSLSLKQRTEMGTSVIKALKYLLLFNISLTFIYTNEVSASPVTLPAAKMSRRPVAVQGMVYCKSCKYSGINTLLEASPLQGATVKLACNNTKRGVTMETKTDKNGYFFMLAPNKLTTYAFHTCRAWPTNPGPAAATVTCTVPSQLNNGTTGAMLKPSKSINIAERGYVLFSVGPFAFEPACTR

SEQ ID NO: 867 - protein, 184 aa, Brassica napus
GDSLSLKQRTEMGTSVIKALKYLLLFNISLTFIYTNEVSASPVTLPAAKMSRRLVAVQGMVYCKSCKYSGINTLLEASPLQGATVKFACNNTKRGVTMETKTDKNGYFFMLAPNKLTTYGFHTCRAWPTNPGPAAATVTCTVPSQLNNGTTGAMLKPSKSINIAERGYVLFSVGPFAFEPACTR

SEQ ID NO: 868 - protein, 512 aa, Arabidopsis thaliana
MCKAEKFLYHRKLWEMKVKFLGDSKIDKLKNSLVLRSRMSLWMIRAMTILLLWSCFVHLVAVGEMWGPRLLKGWPSCFNHHDFPIAAEMTSLPMKIALPPKRIYQNNGYLMVSCNGGLNQMRAAICDMVTIARYMNVTLIVPELDKTSFWNDPSEFKDIFDVDHFISSLRDEVRILKELPPRLKRRVRLGLYHTMPPISWSNMSYYQDQILPLVKKYKVVHLNKTDTRLANNELPVEIQKLRCRANFNGLRFTPKIEELGRRVVKILREKGPFLVLHLRYEMDMLAFSGCSHGCNRYEEEELTRMRYAYPWWKEKVIDSELKRKEGLCPLTPEETALTLSALGIDRNVQIYIAAGEIYGGKRRLKALTDVFPNVVRKETLLDSSDLSFCKNHSSQMAALDYLISLESDIFVPTYYGNMAKVVEGHRRFLGFKKTIELNRKLLVKLIDEYYEGLLSWEVFSTTVKAFHATRMGGPKRRLVIPNKPKEEDYFYANPYECLQLLHENNGNSLEET

SEQ ID NO: 869 - protein, 415 aa, Brassica rapa
  misc_feature (90)..(90): Xaa can be any naturally occurring amino acid
  misc_feature (99)..(99): Xaa can be any naturally occurring amino acid
  misc_feature (135)..(135): Xaa can be any naturally occurring amino acid
ARGSLPPKRVYQNNGYLMVSCNGGLNQMRAAICDMVTVARFMNVTLIVPELDKTSFWNDPSEFKDIFDVDHFITSLRDEVRILKELPPRXKKRVELGMXHEMPPISWSNMSYYQNQILPLVKKHKVLHLNKTDSXLANNGLPVEVQKLRCRVNFNGLKFTPQIEELGRRVVNILREKGPFLVLHLRYEMDMLAFSGCSHGCNPEEEEELTRMRYAYPWWKEKVINSEVKRKEGLCPLTPEETALTLTALGIDRNVQLYIAAGEIYGGERRMKALTDAFPNVVRKETILESSDLDFCRNHSSQMAALDYLVAVESDIFVPTNDGNMARVVEGHRRFLGFKKTIQLNRKFLVKLIDEYTEGLLTWDVFSSMVKAFHSTRMGSPKRRLLIPNKPKEEDYFYSNPQECLQLLDEPLRVI

SEQ ID NO: 870 - protein, 320 aa, Brassica rapa
MPPISWSNMSYYQDQILPLVKKHKVLHLNKTDTRLANNELPVEVQKLRCRVNFNGLRFTPKIEELGRRVVKILREKGPFLVLHLRYEMDMLAFSGCSHGCNRYEEEELTRMRYAYPWWKEKVINSELKRKEGLCPLTPEETALTLSALGIDRNVQIYIAAGEIYGGKRRLKALTDVFPNVVRKETLLDSSDLSFCKNHSSQMAALDYLISLESDIFVPTYYGNMAKVVEGHRRFLGFKKTIELNRKFLVNLIDEYYQGLVSWEVFTTRVKAFHATRMGGPKKRLVIPNKPKEEDYFYANPYECLQLLHENDSGNSLDETI

SEQ ID NO: 871 - protein, 334 aa, Brassica rapa
  misc_feature (90)..(90): Xaa can be any naturally occurring amino acid
  misc_feature (99)..(99): Xaa can be any naturally occurring amino acid
  misc_feature (135)..(135): Xaa can be any naturally occurring amino acid
ARGSLPPKRVYQNNGYLMVSCNGGLNQMRAAICDMVTVARFMNVTLIVPELDKTSFWNDPSEFKDIFDVDHFITSLRDEVRILKELPPRXKKRVELGMXHEMPPISWSNMSYYQNQILPLVKKHKVLHLNKTDSXLANNGLPVEVQKLRCRVNFNGLKFTPQIEELGRRVVNILREKGPFLVLHLRYEMDMLAFSGCSHGCNPEEEEELTRMRYAYPWWKEKVINSEVKRKEGLCPLTPEETALTLTALGIDRNVQLYIAAGEIYGGERRMKALTDAFPNVVRKETILESSDLDFCRNHSSQMAALDYLVAVESDIFVPTNDGNMARVVEGHRR

SEQ ID NO: 872 - protein, 394 aa, Raphanus sativus
  misc_feature (219)..(219): Xaa can be any naturally occurring amino acid
MRAAICDMVTIARYMNVTLIVPELDKTSFWNDPSEFKDIFDVDHFITSLRDEVRILKEVPPRLKRRVELGVYHTMPPISWSNMSYYQDQILPLVKKHKVLHPNKTDTRLANNELPVEVQKLRCRVNFNGLRFTPKIEELGRRVVKILREKGPFLVLHLRYEMDMLAFSGCSHGCNRYEEEELTRMRYAYPWWKEKVINSELKRKEGLCPLTPEETALTXSALGIDRNVQIYIAAGEIYGGKRRLKALTDVFPNVVRKETLLDSSDLSFCKNHSSQMAALDYLISLESDIFVPTYYGNMAKVVEGHRRFLGFKKTIELNRKFLVNLIDEYYEGLLSWEVFSTRVKAFHATRMGGPKKRLVIPNKPKEEDYFYANPYECLQLLHENDNGDSLDETI

SEQ ID NO: 873 - protein, 325 aa, Brassica rapa
MENWAQENLLSYLKPVETSWQPQDLLPQTNDEDQFYEQVKELRDRTREIPDDYFVVLVGDMITEEALPTYQTTLNTLDGVKDETGGSLTPWAVWVRAWTAEENRHGDLLNKYLYLSGRVDMQHVERTIQYLIGSGMDSKFENNPYNGFIYTSFQERATFISHANTAKLATTYGDTTLAKICGTIAADEKRHETAYTRIVEKLFEIDPDGTVQALASMMRKRITMPAHLMHDGRDDNLFDHYGAVAQRIGVYTAMDYAGILEFLLRRWKVESLGVGLTGEGRRAQEYLCSLPQRITRLEERANDRVKLGSRPSVAFSWIYGREVGL

SEQ ID NO: 874 - protein, 403 aa, Brassica napus
  misc_feature (240)..(240): Xaa can be any naturally occurring amino acid
MSIALLLPSPVMTQKPSSITSPPRGFGSSSSRLLQVSCVTKNPSRNNNVTCNNFRPIKEVNNQITHTIPQEKLEIFKSMENWAETTLLPYLKPVEDSWQPQDFLPAPETDDAFYDQVREIRERTREIPDDYFVVLVGDMITEEALPTYQTTLNTLDGVKDETGGSLSPWAVWIRAWTAEENRHGDLLNKYLYLCGRVDMRHVERTIQYLIGSGMDSKFENNPYNGFIYTSFQERATFISXGNTARLATTYGDTTLAKICGTIAADEKRHETAYTKIVEKLFELDPDGTVQALASMMKKRITMPAHLMHDGRDDQLFDHYAAVAQRIGVYTAADYAGILEFLLRRWKVESLGSGLSGEGRRAQEYLCTLPQRIKRLEERANDRVKRQSKGSVSFSWVFGRDVEL

SEQ ID NO: 875 - protein, 130 aa, Arabidopsis thaliana
MGISLVRIDYAPYGQNPPHTHPRATEILVLIEGTLYVGFVSSNQDNNRLFAKVLYPGDVFVFPIGMIHFQVNIGKTPAVAFAGLSSQNAGVITIADTVFGSTPPINPDILAQAFQLDVNIVEDLEAKFRN

SEQ ID NO: 876 - protein, 214 aa, Brassica napus
MRFFKALILIPIAILALVISFAEAYDPSPLQDFCVAIDDLNGVFVNGRFCKDPMRVNAEDFFFSGLNVPGNTSNQVGSNVTTVNVDQIPGLNTMGISLVRIDYAPHGQNPPHTHPRGSEILVLIKGTLYVGFVSSNQDNNRLFAKVLHPGDVFVFPIGMIHFQVNIGKVPAVAFAGLSSQNAGVITIANAVFGSNPPIYPEVLARAFQLDENIV

SEQ ID NO: 877 - protein, 221 aa, Raphanus sativus
  misc_feature (216)..(216): Xaa can be any naturally occurring amino acid
MRFSYALIPIAILALVISFAEAYDPSPLQDFCVAIDDLYGVFVNGRFCKDPMRVNAEDFFFSDLNVPGNTTNQVGSNVTTVNVDQIPGLNTMGISLVRIDYAPYGQNPPHTHPRGSEILVLITGKLYVGFVSSNQDNNRLFAKVLHPGDVFVFPIGMIHFQVNIGKVPAVAFAGLSSQNAGVITIANAVFGSNPPIYPKVLARAFQLDANIVKELXAKFGP

SEQ ID NO: 878 - protein, 174 aa, Brassica oleracea
MERGGFHGYRKFSLNTTNPSEPARFLMAEGSMQLAEPNQTNKTANGGEEECTVREQDRFMPIANVIRIMRRILPAHAKISDDSKETIQECVSEYISFITGEANERCQREQRKTITAEDVLWAMSKLGFDDYIEPLTLYLHRYRELEGDRGVGYNAGSVGMTSGMVVKRPNGTMG

SEQ ID NO: 879 - protein, 381 aa, Brassica rapa
  misc_feature (344)..(344): Xaa can be any naturally occurring amino acid
VPEGFPASVNESYVPYMTFRALKHFFGGAMGVFTTQTLLNSVGAPRNSSASAAVAINWILKDGAGRVGKMLFARQGKKFDYDLKQLRFAGDLLMELGAAVELGTAAVPHLFLPLACAANVVKNVAAVTSTSTRTPIYKAFAKGENIGDVTAKGECVGNIADLMGTGFSILISKRNPSLVTTFGLLSCGYLLSSYQEVRSVVLHTLNRARFTVAVESFIKTGRVPSLQQGNIQEKIFTFPWVEDRPVMLGARFKDAFQDPCTYLAVKPFFDKERYMVTYSPTKGKVYALLKDQASSDDILKAAFHAHVLLHFMNQSKGGASKSVEQLDPPAFAPMEYELESRIAXSCEMVSTSYGIFKSSAAEQGWRMSESLLILAGLGYVI

SEQ ID NO: 880 - protein, 260 aa, Ocimum basilicum
TPQSPVDELVTFIRSYVVPEGFPDSVTPSYVPYMTWRALKHFFGGAMGVFTTQTLLSSLGVARNKATPGAVAINWILKDGAGRVGKMLFARQGKKFDYDLKQLRFAGDLLMELGAGVELATAAVPHLFLPLACAANVAKNVAAVTSTSTRTPIYKAFAKGENIGDVTAKGECVGNLADLLGTGLSIMISKRNPSLFATFGLLSFGYVMSSYQEVKSVVLHTLNRARFTMAAESFLKTGRVPSLQEGNLMENIFVPPWKQH

SEQ ID NO: 881 - protein, 329 aa, Brassica napus
ELCKASKVGHKWNKRASSFPPPQTSSFFLRSLTRMPLKHSSPDPISSSDSIRLLSRETLRISASLAAPPDDLLPQALPDSSQFLRSTLRLICCEEIDGRRWKYVAESDGSGKFKRNSVVRAVSLESPRTPFDEVGSFLRSYVVPEGFPASVNESYVPYMTFRALKHFFGGAMGVFTTQTLLNSVGASRNSSASAAVAINWILKDGAGRVGKMLFARQGKKFDYDLKQLRFAGDLLMELGAAVELGTAAVPHLFLPLACAANVVKNVAAVTSTSTRTPIYKAFAKGENIGDVTAKGECVGNIADLMGTGFSILISKRNPSLVTTFVFYHV

SEQ ID NO: 882 - protein, 385 aa, Brassica napus
MESPSLPVTAKDWTSTSLHRVLCMQGGEGDVSYVNNSDCQALAITLCKPILISSLQSIKLFTSPIIRIADLGCATGSNTFDTVDTVVETLRQLFTTVYGGGSLEFEAFFCDLPSNDFNMLFRLLSEKQKVDSSKYFAGGVAGSFYDRLFPRGTIHVAVSLSALHWLSQIPEKVLEKGSRTWNKGRTWIEGAKKEVVDAYTEQSDKDLDDFLKCRKEEMVEGGVLFVLMGGRPSGSSSQFGDQDTRAKHPFTTTMEQAWQDLIDEGSIDEETRDGFNIPAYMRSPEEVAAGIDRIGGFKIEKMEYMKIVESSDEKHEEWKKDPVSYGRARTNLVQAAIRPMVDVYLGVDLCDELFKRYENRVSTTREFLHITCFFGVVAFSAIRIE

SEQ ID NO: 883 - protein, 228 aa, Arabidopsis thaliana
MASSLKKLISSFLLVLYSTTIIVASSESRCRRFTSIISFGDSIADTGNILHLSDVNHLPQTAFFPYGESFFHPPSGRASDGRLIIDFIAEFLGLPYVPPYFGSQNVSFEQGINFAVYGATALDRAYFVAKGIESDFTNVSLGVQLDIFKQILPNLCASSSRDCREMLGDSLILMGEIGGNDFFYPSSEGKSINETKLQDLIIKAISSAIVVTNLYTNIITYLFYTLTN

SEQ ID NO: 884 - protein, 384 aa, Arabidopsis thaliana
MASSLKKLISSFLLVLYSTTIIVASSESRCRRFKSIISFGDSIADTGNYLHLSDVNHLPQSAFLPYGESFFHPPSGRASNGRLIIDFIAEFLGLPYVPPYFGSQNVSFEQGINFAVYGATALDRAFLLGKGIESDFTNVSLSVQLDTFKQILPNLCASSTRDCKEMLGDSLILMGEIGGNDYNYPFFEGKSINEIKELVPLIVKAISSAIVDLIDLGGKTFLVPGGFPTGCSAAYLTLFQTVAEKDQDPLTGCYPLLNEFGEHHNEQLKTELKRLQKFYPHVNIIYADYHNSLYRFYQEPAKYGFKNKPLAACCGVGGKYNFTIGKECGYEGVNYCQNPSEYVNWDGYHLTEAAYQKMTEGILNGPYATPAFDWSCLGSGTVDT

SEQ ID NO: 885 - protein, 233 aa, Brassica rapa
MASPLKKLISTFLFLLSSTVIMVASSEPLCHPYKSIISFGDSIADTGNYLRLSDVNHLPQAAFLPYGETFFQPPSGRYSDGRLIIDFIAEFLGLPYVPPYFGSQNVSFEQGINFAVYGATALDRAFLMEKGIESDFTNVSLNVQLNTFKQILPNLCASTSRDCREMLGDSLILMGEIGGNDYNYPFFEGKSINGIKELVPLIIKTISSAIVDLVDLGSKTFLVPGNFPIGCSA

SEQ ID NO: 886 - protein, 152 aa, Raphanus sativus
MGALEFLSDYFSNNFDVSIRKRKKHKVMQTVNIKVKIDCDGCERKIKNAVSFMKGAKSVEVNRKMHKVTVSGYVHPKKVLKRVQSTGKKKAELWPYVPYTMVAYPYAAGAYDKRAPAGFVRKSEQAQAQPGGTDDKLMSLFSDENPNACIVM

SEQ ID NO: 887 - protein, 144 aa, Thellungiella halophila
MGALDFLSDYLSDHFYVSIRKRKKHKVMQTVNIKVKIDCDGCERKIKNAVSSMKGAKSVEVNRKMNKVTVSGYVDPKKVLKRVQSTGKKKAELWPYVPYTMVAYPYAAGAYDKRAPPGFVRKSEQAQAQPGGTDDKLMSLFSDE

SEQ ID NO: 888 - protein, 503 aa, Brassica napus
  misc_feature (246)..(246): Xaa can be any naturally occurring amino acid
IDIRPPDDETHLVSWKSQLERDMNMIQTQDNRNHIMEVLSENDLICDDLESISFEDTKVLSNYIEEIVVSALSYHLMNNKDPEYRNGKLVISSTSLSHGFSLFREGKASGREKLKQTAKEDKSKEPKAELAAAVKPDTKPESIATASSSKTEPEKETKSEKAATPKAAEVPPDNEFEKRIRPEVIPAEEINVTFEDIGALDDIKESLQELVMLPLRRPDLFTGGLLKPCRGILLFGPPGTGKTMLXKAIAREAGASFINVSMSTITSKWFGEDEKNVRALFTLASKVSPTIIFVDEVDSMLGQRTRVGEHEAMRKIKNEFMSHWDGLMTKPGERILVLAATNRPFDLDEAIIRRFERRILVGLPGVENREKILKTLLAKEEVDENLDYKELSMMTEGYTGSDLKNLCTTAAYRPVRELIQQERIKDTEKKKQREATKTSEDDEGKEERIITLRPLNRQDFKEAKNQVAASFAAEGAGMGELKQWNELYGEGGSRKKEQLTYFL

SEQ ID NO: 889 - protein, 150 aa, Brassica oleracea
MSLNTILTWSLVFFLFLTVSDQKPTAYDAVKSYNLPPGILPKGVVDYELNPKTGDFKVYFNGTCDFSIQSYQLKYKSTISGVISTGQVKNLKGVSVKVLFFWVNIVEVSLDGGDLDFSVGIASASFPAVDFEESPQCGCGFDCNGLLFSS

SEQ ID NO: 890 - protein, 150 aa, Brassica napus
MSLNTILTWSLVFFLFLTVSDQKPTAYDAVKSYNLPPGILPKGVVDYELNRKTGDFKVYFNGTCDFSIQSYQLKYKSTISGVISAGQVKNLKGVSVKVLFFWVNIVEVSLDGGDLDFSVGIASASFPAVDFEESPQCGCGFDCNGLLFSS

SEQ ID NO: 891 - protein, 150 aa, Brassica napus; identical to SEQ ID NO: 889

SEQ ID NO: 892 - protein, 202 aa, Brassica oleracea
  misc_feature (155)..(155): Xaa can be any naturally occurring amino acid
MAMECITALPQRFSENKTKEDPSIFDANLLNQQSNHIPQQFVWPDHEKPSSDVQPLQVPLVDLAGFLSGDPFLVSEATRLVSEASKKHGFFLVTNHGVDETLLSRAHLFMDSFFKAPACEKQKARRKWGESSGYASSFVGRYSSKLPWKETLSFXFSPEEKCHSQNIKDFVSEKMGDGYDDFGKVYQEYAEAMNILSLKIME

SEQ ID NO: 893 - protein, 379 aa, Brassica napus
MAMECITALPQRFSENKTKEDPSIFDANLLNQQSNHIPQQFVWPDHEKPSSDVQPLQVPLVDLAGFLSGDPFLVSEATRLVSEASKKHGFFLVTNHGVDETLLSRAHLFMDSFFKAPACEKQKARRKWGESSGYASSFVGRYSSKLPWKETLSFKFSPEEKCHSQNIKDFVSEKMGDGYDDFGKVYQEYAEAMNILSLKIMELLGMCLGIERRHFRDFFEDNESILRLNYYPQCKQPELALGTGPHCDPTSLTILHQDQVDGLEVFVDNKWQSIPPNPQSVVVNIGDTFMALTNGIYKSCLHRAVVNSEKDRKTLAFFLCPKKDKVVKPPEELVRVMSGEREYPDFTWSMFLEFTQKHYRSDMNTLEEFSNWLKNRRSF

SEQ ID NO: 894 - protein, 221 aa, Brassica napus
MAMECIATLPERFNDNKTKEDPSIFDANLLNQLSNHIPQQFVWPDHEKPSTDVQPLQAPLIDLAGFLSGDSFLVSEATRLVSEASKKHGFFLVTNHGVDETLLSRAYLFMDSFFKAPACEKQKAQRTWGESSGYASSFVGRFSSKLPWKETLSFKFSPEEKCQSQAVKDFVSKKMGDEYENFGKVYQEYADAMNILSLKIMELLGMSLGIERRHFRNFFED

SEQ ID NO: 895 - protein, 175 aa, Brassica napus
NPLLYKVQSPDEFSDLLILSYSNFIQNLYSLGARRIGVTTLPPLGCLPAAITVAGPHEGGCSESLNNDAISFNTKLNATSQDLKRNLIGLNLVVFDIYQPLYDLATRPSEFGFAEARRACCGTGLLETSILCNPKSVGTCTNATEYVFWDGFHPTEAANKILSDNLLLSGISLIS

SEQ ID NO: 896 - protein, 317 aa, Brassica rapa
  misc_feature (294)..(294): Xaa can be any naturally occurring amino acid
  misc_feature (309)..(310): Xaa can be any naturally occurring amino acid
  misc_feature (316)..(317): Xaa can be any naturally occurring amino acid
MSSSSSRNAFVDGKYKPDLLTVDLASRCRCYKTTPSSSLTPPPPPKSLLVATPVEEGEYPVVMLLHGYLLYNSFYSQLMLHVSSYGFIVIAPQLYNIAGPDTMDEIKSTAEIIDWLSVGLNHFLPPQVTPNLSKFALTGHSRGGKTAFAVALKKFGYSSELKISALIGVDPVDGTGKGKQTPPPVLTYEPNSFNLEKMPVLVIGSGLGELARNPLFPPCAPTGVNHREFFQECQGPAWHFVAKDYGHLDMLDDDTKGLRGKSSYCLCKNGEERKPMRRFIGGIVVSFLMAYLEXDDCELMKIKNGCHEXXPVEIQXX

SEQ ID NO: 897 - protein, 318 aa, Raphanus sativus
MPSSSSRNAFVDGKHKTDLLTVDLSRCCKTTPSSSMTPPPPPKGLLVATPVEEGEYPVVMLLHGYLLYNSFYSQLMLHVSSHGFIVIAPQLYSIAGPDTMDEIKSTAEIIDWLSDGLDHFLPPQVTPDLSKFALSGHSRGGKTAFSVALKKFGYSSDLKISALIGIDPVDGTGKGKQTPPPVLTYEPNSFDLDKMHVLVIGSGLGELARNPLFPPCAPPGVNHREFFRESQGPAWHFVAKGYGHLDMLDDDTKGLRGKSSYCLCKNGEQRRPMRIFVGGIVVSFLMACLEGDERELVKIKDGGHEGLPVEIQEFEVKK

SEQ ID NO: 898 - protein, 555 aa, Brassica rapa
  misc_feature (191)..(191): Xaa can be any naturally occurring amino acid
MKNNNNKSSSSYDSSLSPSSSSTSHQNWLSFSLSNNNNFNSSSNPNLATSTSDHHHHPHPSHVSLFQAFSTTPVHRHDESPGTSSGDATAALSMYPGGPKLENFLGGGATTTTTGQMQQGQSLGGVVFSSNVEQPRHPPSAAEIYDYELKSIAASFLGNYSGGHSSEVSSGQKQQHNPPTATEASPTPKKXVESFGQRTSIYRGVTRHRWTGRYEAHLWDNSCRREGQSRKGRQVYLGGYDKEDKAARAYDLAALKYWGPTTTMNFSISNYEPELEEMKHMTRQEFVASLRRKSSGFSRGASMYRGVTRHHQHGRWQARIGRVAGNKDLYLGTFSTQEEAAEAYDIAAIKFRGLNAVTNFDISRYDVKSIASCNLPVGGLNPKPSPVTPAPDKQVDISPSDPPSLTTPSLTFNAATPVHDHEGAFFHTGIPIKQDPAAHYWSNVFGFPPNLKTETRPIATFGSDLHSTSPGFTVMPVMQDGGNNFGGGFVESEGYNNNHSAASSPVSAIPLPSTVDNSNEGYGGNINWISNNTSNSYQTAKSNLSVLQTPVFGLE

SEQ ID NO: 899 - protein, 214 aa, Brassica napus
MKREYLDYILVPLGMGLMIFYHLWLLHRIIHRPSSTVVGLNAFNRRLWVQAMMEDAPKNGVLAVQTLRNNIMASTLLASTAIMLCSLIAVLMTSGTGERSVWFVFGDKSDQAFSIKFFAILVCFLVAFLLNVQSIRYYSHASILINVPFKQLMAVSSGGHSLMINQDYVAATVNRGSYFWSLGLRAFYFSSPLFLWIFGPIPMFITCCVLVSLL

SEQ ID NO: 900 - protein, 235 aa, Brassica napus
MKLEYLDYILVPLGMGLMVFYHLWLLHRIIHRPSSTVVGLNAFNRRLWVQAMMEDSSKNGVLAVQTLRNNIMASTLLASTAIMLCSLIAVLMTSGTGERSVWFVFGDKSDRAFSIKFFSILVCFLVAFLLNVQSIRYYSHASILINVPFKKLMAVSSDGHGRGSLMINQDYVAATVNRGSYFWSLGLRAFYFSSPLFLWIFGPIPMLITCCVLVSLLYFLDLTFDSMDCSVGVAD

SEQ ID NO: 901 - protein, 248 aa, Raphanus sativus
MKLEYLDYILVPLGMGLMVFYHLWLLHRIIHRPSSTVVGLNAFNRRLWVQAMMEDSSKNGVLAVQTLRNNIMASTLLASTAIMLCSLIAVLMTSGTGERSVWFVFGDKSDRAFSIKFFSILVCFLVAFLLNVQSIRYYSHASILINVPFKKLMAVSAGGHGRGSLMINQDYVAATVNRGSYFWSLGLRAFYFSSPLFLWIFGPIPMLITCCVLVSLLYFLDLTFDSMDCSVGVADAEETEIRSLADNV

SEQ ID NO: 902 - protein, 363 aa, Brassica rapa
DKMVDYLRSSVGIIHRNHAESITTFIKESVDSELKDPNANPKKRLTFCVEGNISVGKSTFLQRIANETIELRDLVEIVPEPVDKWQDVGPDHFNILDAFYSEPQRYAYTFQNYVFVTRLMQEKESASGVKPLRLMERSVFSDRMVFVRAVHEAKWMNEMEISIYDSWFDPVVSALPGLVPDGFIYLRASPDTCHKRMMLRKRAEEGGVSLKYLQDLHEKHESWLLPFESGNHGVLSVSKPSLQMDNNSLHPDIKDRVFYLEGNHMHSSIQKVPALVLDCEPNIDFSRDIEAKRQYARQVAEFFEFVKKKQETSQEKGNSQSPLLIPPQKGGLWMGPEGKHVPGLELESLDFRKAMSLLTRPSA

SEQ ID NO: 903 - protein, 297 aa, Raphanus sativus
  misc_feature (2)..(2): Xaa can be any naturally occurring amino acid
QXIANETIELRDLVEIVPEPVDKWQDVGPDHFNILDAFYSEPQRYAYTFQNYVFVTRLMQEKESASGVKPLRLMERSVFSDRMVFVRAVHEAKWMNEMEISIYDSWFDPVVSALPGLVPDGFIYLRASPDTCHKRMMLRKRAEEGGVSLKYLQDLHEKHESWLLPFESGNHGVLSVSKPSLQMDNSLHPDIKDRVFYLEGNHMHSSIQKVPALVLDCEPNIDFSRDIEAKRQYARQVAEFFEFVKKKQETSQEQSPLLMPPHNGGLWMGPEGKHVPGLELPSLDFRKAMSLITRPSA

SEQ ID NO: 904 - protein, 300 aa, Brassica rapa
  misc_feature (8)..(8): Xaa can be any naturally occurring amino acid
MASSSSSXALYRISNLQNHISPLEATNKLRSLVKISPQVSEALSNGRAVVALESTIISHGMPYPQNLQTAKEVESIVRENGAVPATIAILNGVPCIGLNEEELERLASLGKSVQKTAGRDIAYVVATRGNGATTVSATLFFASMVGIQVFVTGGIGGVHRHANQTMDISSDLTALGRTPIAVISAGVKSILDIPKTLEYLETQEVYVAAYKSDEFPAFFTEKSGCKAPSRVDSPEDCARVIDANKKLNRQAGILFAVPIPKQHSAAGNLIESATQRALTEAREQNVTGNAETPFLLARGK

SEQ ID NO: 905 - protein, 331 aa, Brassica napus
  misc_feature (243)..(243): Xaa can be any naturally occurring amino acid
  misc_feature (245)..(245): Xaa can be any naturally occurring amino acid
  misc_feature (248)..(248): Xaa can be any naturally occurring amino acid
  misc_feature (331)..(331): Xaa can be any naturally occurring amino acid
MASSSSSLSRISTLQNHISPLEANNKLRSLVKISPQVSEAISSGRAVVALESTIISHGMPYPQNLQTAKEVESIVRENGAVPATIAILNGVPCIGLNEEELERLASLGKSIQKTAGRDIPHVVATRANGATTVSATLFFASMVGIQVFVTGGIGGVHRHANHTMDISSDLTALGRTPIAVISAGVKSILDIPKTLEYLETQEVYVAAYKSDEFPAFFTEKSGCKAPSRVDSPEDCARVIDANXKXNRXAGILFAVPIPKQHSAAGNLIESATQRALTEAREQNVTGNAETPFLLARVNELTGGTSLAANIALVKNNALIGSQIAVALSQLX

SEQ ID NO: 906 - protein, 359 aa, Raphanus sativus
  misc_feature (1)..(1): Xaa can be any naturally occurring amino acid
  misc_feature (63)..(63): Xaa can be any naturally occurring amino acid
  misc_feature (262)..(262): Xaa can be any naturally occurring amino acid
  misc_feature (270)..(270): Xaa can be any naturally occurring amino acid
  misc_feature (300)..(300): Xaa can be any naturally occurring amino acid
  misc_feature (305)..(305): Xaa can be any naturally occurring amino acid
  misc_feature (310)..(310): Xaa can be any naturally occurring amino acid
  misc_feature (356)..(356): Xaa can be any naturally occurring amino acid
XFCFFYNGERVAATSSSSFRASRTSSREMASSSSALYRISNLQNHISPLEANNKLRSLVKVSXEVSEAISNGRAVVALESTIISHGMPYPQNLQTAKEVESIVRENGAVPATIAILNGVPCIGLNEEELERLASLGKSVQKTAGRDIAYVVATRGNGATTVSATLFFASLVGIQVFVTGGIGGVHRHANQTMDISSDLTALGRTPIAVISAGVKSILDIPKTLEYLETQEVYVAAYKSDEFPAFFTEKSGCKAPSRVDSPEXCARVIDAXMKLNRQAGILFAVPIPKQHSAAGNLIESAXQRALXEAREXNVTGNAETPFLLARVNELTGGTSLAANIALVKNNALIGSQIAVALXQLM

SEQ ID NO: 907 - protein, 487 aa, Arabidopsis thaliana
MEDAESTTKDPVDRVEKVTWRDLQDGSFTAELKKLICFAAPMAAVVITQSMLQIITMVIVGHLGRLSLASASFAISFCNVTGFSFIMGLSCALDTLSGQAYGAKLYRKLGVQAYTAMFCLTLVCLPLSLLWFNMGKLLVILGQDPSIAHEAGRFAAWLIPGLFAYAVLQPLTRYFKNQSLITPLLITSCVVFCLHVPLCWLLVYKSGLDHIGGALALSLSYWLYAIFLGSFMYFSSACSETRAPLTMEIFEGVREFIKYALPSAAMLCLEWWSYELIILLSGLLPNPQLETSVLSVCLQTLSMTYSIPLAIAAAASTRISNELGAGNSRAAHIVVYAAMSLAVVDALMVGTSLLAGKNLLGQVFSSDKNTIDYVAKMAPLVSISLILDSLQGVLSGVASGCGWQHIGAYINFGAFYLWGIPIAASLAFWVHLKGVGLWIGIIAGAVLQTLLLALVTGCINWENQAREARKRMAVAHESELTESELPF

SEQ ID NO: 908 - protein, 153 aa, Brassica oleracea
MRMSCNGCRVLRKGCSENCSIRPCLQWIKSAESQANATVFLAKFYGRAGLMNLLSTGPDHLRPAIFRSLLYEACGRIVNPIYGSVGILWSGNWHLCQAAVEAVMRGSPVTPIACDAAVTGQAPPFNNNKLFDIRHVSRDENAVKSRCRSSRSG

SEQ ID NO: 909 - protein, 247 aa, Brassica napus
MRMSCNGCRVLRKGCSENCSIRPCLQWIKSAESQANATVFLAKFYGRAGLMNLLSTGPDHLRPAIFRSLLYEACGRIVNPIYGSVGILWSGNWHLCQAAVEAVMRGSPVTPIACDAAVTGQAPPFNNNKLFDIRHVSRDENAVKSRCRSSRSGACKEGRNVRSSLSHESSLSHESAVVKGEGSMVSSEETTEEPSWIGLELTLGLEPSGARGSHVVVPIKKRKLEKSGTCDDDADTCKIELGLVCSE

SEQ ID NO: 910 - protein, 687 aa, Arabidopsis thaliana
MELESTSNGRRPPPPAEIGRGAYLAWEDLTVVIPNFSGGPTRRLLDGLNGHAEPGRIMAIMGPSGSGKSTLLDSLAGRLARNVIMTGNLLLNGKKARLDYGLVAYVTQEDILMGTLTVRETITYSAHLRLSSDLTKEEVNDIVEGTIIELGLQDCADRVIGNWHSRGVSGGERKRVSVALEILTRPQILFLDEPTSGLDSASAFFVIQALRNIARDGGRTVVSSIHQPSSEVFALFDDLFLLSSGETVYFGESKFAVEFFAEAGFPCPKKRNPSDHFLRCINSDFDTVTATLKGSQRIRETPATSDPLMNLATSEIKARLVENYRRSVYAKSAKSRIRELASIEGHHGMEVRKGSEATWFKQLRTLTKRSFVNMCRDIGYYWSRIVIYIVVSFCVGTIFYDVGHSYTSILARVSCGGFITGFMTFMSIGGFPSFIEEMKVFYKERLSGYYGVSVYIISNYVSSFPFLVAIALITGSITYNMVKFRPGVSHWAFFCLNIFFSVSVIESLMMVVASLVPNFLMGLITGAGIIGIIMMTSGFFRLLPDLPKVFWRYPISFMSYGSWAIQGAYKNDFLGLEFDPMFAGEPKMTGEQVINKIFGVQVTHSKWWDLSAIVLILVCYRILFFIVLKLKERAEPALKAIQAKRTMKSLKKRPSFKKVPSLSSLSSRRHQPLHSLSSQEGLTSPIN

SEQ ID NO: 911 - protein, 100 aa, Brassica napus
MEMKWLLTSAFTQMFGYSNQINQTSNSLSTRNKIKMMKKEEYPRGFQVPLHYPKYSKSDYEAMDDLSLDLLLKQYGISFEGSLEDKRVFAMESFLWPDQL

SEQ ID NO: 912 - protein, 109 aa, Brassica oleracea
MARGSSQSQQSTSTASSTARPGLAAPRGSAAATAGMRRRRLGGGGSASSGGGSVAGSGSSNMLRFYTDEAPGLKISPTVVLIMSLCFIGFVTALHVFGKLYLHKSGSKA

SEQ ID NO: 913 - protein, 109 aa, Brassica rapa
MAKGSSQSQQSTSTASSASRPGLAAPRGSAAATAGMRRRKLGGGGGASAGGGSGAGGGSNNMLRFYTDEAPGLKISPTVVLIMSLCFIGFVTALHVFGKLYLHKSGSKA

SEQ ID NO: 914 - protein, 109 aa, Brassica rapa
MARGSSQSQQSTSTASSTARPGLAAPRGSAAATAGMRRRRLGGGGGASSGGGSVAGSGSSNMLRFYTDEAPGLKISPTVVLIMSLCFIGFVTALHVFGKLYLHKSGSKA

SEQ ID NO: 915 - protein, 109 aa, Brassica napus
  misc_feature (16)..(16): Xaa can be any naturally occurring amino acid
MAKGSSQSQQSTSTAXSASRPGLAAPRGSAAATAGMRRRKLGGGGGASAGGGSGAGGGSNNMLRFYTDEAPGLKISPTVVLIMSLCFIGFVTALHVFGKLYLHKSGSKA

SEQ ID NO: 916 - protein, 109 aa, Brassica napus; identical to SEQ ID NO: 914

SEQ ID NO: 917 - protein, 59 aa, Raphanus sativus
  misc_feature (3)..(3): Xaa can be any naturally occurring amino acid
  misc_feature (27)..(27): Xaa can be any naturally occurring amino acid
GGXVGGGGSSNMLRFYTDEAPGLKISXTVVLIMSLCFIGFVTALHVFGKLYLHKSGSKA

SEQ ID NO: 918 - protein, 96 aa, Thellungiella halophila
TASSTARPGLAAPRGSAAATAGMRRRRLGGGGGLSSGGGSAAGSGSSNMLRFYTDEAPGLKISPTVVLIMSLCFIGFVTALHVFGKLYLHKSGSKA

SEQ ID NO: 919 - protein, 215 aa, Brassica rapa
MQFSRNSILRQLSRKEGWRSASRRWTSGDSSTAFADDTSGGAGGYSSMEGLYGVYSGEDPAARRKRVMVVVDEASRSKHAMMWALTHLTNKGDLMTLLHVVSPHDEASSSLVQSLGSLCKACKPEVDVEALVIQGPKLATVLSQVKKLEVTVLVLGQKKSAPFISCLCGPSRSEELVNRCINGADCLTIGVRKQSNGVSGYLINTRWQKNFWLLA

SEQ ID NO: 920 - protein, 144 aa, Brassica napus
MQFSRNSILRQRSRKEGWRSASKRWTSGDSSTAFTDATSCGGGYSSMEGLYGVYSNGDTATRSKRVMVVVDETSRSEHAMMWALTHLTNKGDLMTLLHVVSPHDEASPSLVQSLGSLCKACKPEVDVEALVVQGPKLATILSQV

SEQ ID NO: 921 - DNA, 877 bp, Artificial sequence
  CaMV 35S promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 922 - DNA, 277 bp, Artificial sequence
  3'UTR of the nopaline synthase gene
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 923 - DNA, 30 bp, Artificial sequence
  Single strand DNA oligonucleotide
aatgtcgacgatgcatggattcaatcaaca

SEQ ID NO: 924 - DNA, 33 bp, Artificial sequence
  Single strand DNA oligonucleotide
tttgtcgaccattgtgaagtatagtccttgatg

SEQ ID NO: 925 - DNA, 29 bp, Artificial sequence
  Single strand DNA oligonucleotide
tatctagaacataaacggggagactcaag

SEQ ID NO: 926 - DNA, 32 bp, Artificial sequence
  Single strand DNA oligonucleotide
aatctagactatggtaacccgaagttgtatac

SEQ ID NO: 927 - DNA, 29 bp, Artificial sequence
  Single strand DNA oligonucleotide
actgtcgacagacatgcacaaagacaacg

SEQ ID NO: 928 - DNA, 29 bp, Artificial sequence
  Single strand DNA oligonucleotide
atagtcgaccaaaacccagagacatgcac

SEQ ID NO: 929 - DNA, 31 bp, Artificial sequence
  Single strand DNA oligonucleotide
aatctagacacttttcaaagagaggacatct

SEQ ID NO: 930 - DNA, 30 bp, Artificial sequence
  Single strand DNA oligonucleotide
actctagaccggttcacttaagatttattc

SEQ ID NO: 931 - DNA, 30 bp, Artificial sequence
  Single strand DNA oligonucleotide
aaagtcgaccaatcatggcagcatcaaaac

SEQ ID NO: 932 - DNA, 32 bp, Artificial sequence
  Single strand DNA oligonucleotide
agtctagacggatgattgattcgatagtacac

SEQ ID NO: 933 - DNA, 28 bp, Artificial sequence
  Single strand DNA oligonucleotide
tgagctcccaatcaagaactaaggaccg

SEQ ID NO: 934 - DNA, 37 bp, Artificial sequence
  Single strand DNA oligonucleotide
aatgtcgacaacaatgaatatgatgatgcaaaaactc

SEQ ID NO: 935 - DNA, 30 bp, Artificial sequence
  Single strand DNA oligonucleotide
aatctagacggtctttagagtccagaagtg

SEQ ID NO: 936 - DNA, 29 bp, Artificial sequence
  Single strand DNA oligonucleotide
aatctagaatcattgcaacttaaacacga

SEQ ID NO: 937 - DNA, 34 bp, Artificial sequence
  Single strand DNA oligonucleotide
aatgtcgaccctctgtcttgtcttttggttagta

SEQ ID NO: 938 - DNA, 28 bp, Artificial sequence
  Single strand DNA oligonucleotide
aatctagaccttcaactacaagcggctt

SEQ ID NO: 939 - DNA, 33 bp, Artificial sequence
  Single strand DNA oligonucleotide
acggtcgaccttacaataaaatggtgaaactcg

SEQ ID NO: 940 - DNA, 32 bp, Artificial sequence
  Single strand DNA oligonucleotide
aatgtcgacctctctaaacgcataatcttaca

SEQ ID NO: 941 - DNA, 29 bp, Artificial sequence
  Single strand DNA oligonucleotide
aatctagacaaaatatgtggtctccgcag

SEQ ID NO: 942 - DNA, 28 bp, Artificial sequence
  Single strand DNA oligonucleotide
agtctagacaaaaaggaaacgaatcaca

SEQ ID NO: 943 - DNA, 31 bp, Artificial sequence
  Single strand DNA oligonucleotide
caagtcgaccgtaagacataagcaaaatggc

SEQ ID NO: 944 - DNA, 32 bp, Artificial sequence
  Single strand DNA oligonucleotide
ttagtcgaccacttcatgcgtaagacataagc

SEQ ID NO: 945 - DNA, 29 bp, Artificial sequence
  Single strand DNA oligonucleotide
gctctagagcatcttttaagttgacgtcg

SEQ ID NO: 946 - DNA, 27 bp, Artificial sequence
  Single strand DNA oligonucleotide
aatctagatccattgaaaatgcgaacc

SEQ ID NO: 947 - DNA, 31 bp, Artificial sequence
  Single strand DNA oligonucleotide
aatgtcgacgttctatccccaactctaaatg

SEQ ID NO: 948 - DNA, 32 bp, Artificial sequence
  Single strand DNA oligonucleotide
attctagattgttgtttgtatcactttattgg

SEQ ID NO: 949 - DNA, 31 bp, Artificial sequence
  Single strand DNA oligonucleotide
agagctccttaaagttctatcgagatagtgc

SEQ ID NO: 950 - DNA, 31 bp, Artificial sequence
  Single strand DNA oligonucleotide
agagctctcaatgaaattttacataaccatc

SEQ ID NO: 951 - DNA, 36 bp, Artificial sequence
  Single strand DNA oligonucleotide
aatgtcgacaacaatggatctacaacagtccgaaac

SEQ ID NO: 952 - DNA, 32 bp, Artificial sequence
  Single strand DNA oligonucleotide
aatctagacactcagacagctgggtattaaac

SEQ ID NO: 953 - DNA, 28 bp, Artificial sequence
  Single strand DNA oligonucleotide
agagctcgttgtggcactcagacagctg

SEQ ID NO: 954 - DNA, 31 bp, Artificial sequence
  Single strand DNA oligonucleotide
ttcgtcgacaaaggaatatgagaatcagctg

SEQ ID NO: 955 - DNA, 34 bp, Artificial sequence
  Single strand DNA oligonucleotide
aacgtcgaccaaacacacatcatacgtatatttg

SEQ ID NO: 956 - DNA, 34 bp, Artificial sequence
  Single strand DNA oligonucleotide
attctagagagtttatgataacctaatgattgac

SEQ ID NO: 957 - DNA, 34 bp, Artificial sequence
  Single strand DNA oligonucleotide
gttctagacagagtgagtttatgataacctaatg

SEQ ID NO: 958 - DNA, 34 bp, Artificial sequence
  Single strand DNA oligonucleotide
aatgtcgacaacaatgtccaccgttaatcatcac

SEQ ID NO: 959 - DNA, 32 bp, Artificial sequence
  Single strand DNA oligonucleotide
aatctagacagaaccaaaactctcgtattaac

SEQ ID NO: 960 - DNA, 32 bp, Artificial sequence
  Single strand DNA oligonucleotide
aatctagagaaactttgaatggactatgtagc

SEQ ID NO: 961 - DNA, 28 bp, Artificial sequence
  Single strand DNA oligonucleotide
aatctagatacaatggcggatacacacc

SEQ ID NO: 962 - DNA, 29 bp, Artificial sequence
  Single strand DNA oligonucleotide
attctagagcttacaatggcggatacaca

SEQ ID NO: 963 - DNA, 30 bp, Artificial sequence
  Single strand DNA oligonucleotide
agagctcgtgaaaacacatatctaccgttc

SEQ ID NO: 964 - DNA, 28 bp, Artificial sequence
  Single strand DNA oligonucleotide
agagctccttgcgatctttcatgcttac

SEQ ID NO: 965 - DNA, 29 bp, Artificial sequence
  Single strand DNA oligonucleotide
agagctcagagagagatagggctttgagg

SEQ ID NO: 966 - DNA, 31 bp, Artificial sequence
  Single strand DNA oligonucleotide
agagctcgaagaagaacacaaaacagtagag

SEQ ID NO: 967 - DNA, 31 bp, Artificial sequence; identical to SEQ ID NO: 966
  Single strand DNA oligonucleotide

SEQ ID NO: 968 - DNA, 29 bp, Artificial sequence
  Single strand DNA oligonucleotide
aaagtcgacagagacaaagaagttggcca

SEQ ID NO: 969 - DNA, 31 bp, Artificial sequence
  Single strand DNA oligonucleotide
tttctagatgcaagattcaaatacgacttag

SEQ ID NO: 970 - DNA, 31 bp, Artificial sequence
  Single strand DNA oligonucleotide
agagctcggaccatttaccttgatttgttac

SEQ ID NO: 971 - DNA, 32 bp, Artificial sequence
  Single strand DNA oligonucleotide
aatgtcgacaagcatgtttaaactctgtctcg

SEQ ID NO: 972 - DNA, 31 bp, Artificial sequence
  Single strand DNA oligonucleotide
ttagtcgacgaaaggaaaagcatgtttaaac

SEQ ID NO: 973 - DNA, 32 bp, Artificial sequence
  Single strand DNA oligonucleotide
ccgtctagaggaaacttttaattgtcatgtga

SEQ ID NO: 974 - DNA, 31 bp, Artificial sequence
  Single strand DNA oligonucleotide
aatctagacatcataatcatatggagttcga

SEQ ID NO: 975 - DNA, 31 bp, Artificial sequence; identical to SEQ ID NO: 974
  Single strand DNA oligonucleotide

SEQ ID NO: 976 - DNA, 30 bp, Artificial sequence
  Single strand DNA oligonucleotide
aatctagagatctagggtttcatgcttcac

SEQ ID NO: 977 - DNA, 30 bp, Artificial sequence
  Single strand DNA oligonucleotide
agagctcgttcgacttgtttatattgcacg

SEQ ID NO: 978 - DNA, 29 bp, Artificial sequence
  Single strand DNA oligonucleotide
attctagactccgagactgtctccgattg

SEQ ID NO: 979 - DNA, 27 bp, Artificial sequence
  Single strand DNA oligonucleotide
attctagacaatcaccgtggacacctc

SEQ ID NO: 980 - DNA, 30 bp, Artificial sequence
  Single strand DNA oligonucleotide
attctagagtggcaacatctgaagtattcc

SEQ ID NO: 981 - DNA, 29 bp, Artificial sequence
  Single strand DNA oligonucleotide
agagctctcattacagtgactctgcatgc

SEQ ID NO: 982 - DNA, 32 bp, Artificial sequence
  Single strand DNA oligonucleotide
agagctctcttgtctactttcattacagtgac

SEQ ID NO: 983 - DNA, 31 bp, Artificial sequence
  Single strand DNA oligonucleotide
tagagctcgaaagtacataatggacatgagc

SEQ ID NO: 984 - DNA, 35 bp, Artificial sequence
  Single strand DNA oligonucleotide
tagagctcgatttttaaagtagttatagtgatgaa

SEQ ID NO: 985 - DNA, 35 bp, Artificial sequence; identical to SEQ ID NO: 984
  Single strand DNA oligonucleotide

SEQ ID NO: 986 - DNA, 32 bp, Artificial sequence
  Single strand DNA oligonucleotide
agagctcgtaatattaccataaggttcagaag

SEQ ID NO: 987 - DNA, 31 bp, Artificial sequence; identical to SEQ ID NO: 983
  Single strand DNA oligonucleotide

SEQ ID NO: 988 - DNA, 35 bp, Artificial sequence; identical to SEQ ID NO: 984
  Single strand DNA oligonucleotide

SEQ ID NO: 989 - DNA, 32 bp, Artificial sequence
  Single strand DNA oligonucleotide
aatctagactcttacacatgtatcggtagttg

SEQ ID NO: 990 - DNA, 33 bp, Artificial sequence
  Single strand DNA oligonucleotide
aatctagacttaaaacattggaaacaagaattc

SEQ ID NO: 991 - DNA, 32 bp, Artificial sequence
  Single strand DNA oligonucleotide
agagctcgatcagaaatacatgacgatagatg

SEQ ID NO: 992 - DNA, 27 bp, Artificial sequence
  Single strand DNA oligonucleotide
agagctcgcatctttgtttttggacga

SEQ ID NO: 993 - DNA, 32 bp, Artificial sequence
  Single strand DNA oligonucleotide
aaagtcgacgagagatggctaaatcagatatg

SEQ ID NO: 994 - DNA, 33 bp, Artificial sequence
  Single strand DNA oligonucleotide
aatgtcgacgagagtgagagatggctaaatcag

SEQ ID NO: 995 - DNA, 30 bp, Artificial sequence
  Single strand DNA oligonucleotide
attctagaagaagcaatcaccattttaagg

SEQ ID NO: 996 - DNA, 29 bp, Artificial sequence
  Single strand DNA oligonucleotide
attctagaccgaaaatccaatttagttgc

SEQ ID NO: 997 - DNA, 31 bp, Artificial sequence
  Single strand DNA oligonucleotide
aatgtcgacgatttcttctccttaagccatg

SEQ ID NO: 998 - DNA, 34 bp, Artificial sequence
  Single strand DNA oligonucleotide
aatgtcgacggagagtttttctttattactaggg

SEQ ID NO: 999 - DNA, 31 bp, Artificial sequence
  Single strand DNA oligonucleotide
aatctagacacacatcatttcataagtgacc

SEQ ID NO: 1000 - DNA, 29 bp, Artificial sequence
  Single strand DNA oligonucleotide
aatctagacaaccattattaccgaagagc

SEQ ID NO: 1001 - DNA, 31 bp, Artificial sequence
  Single strand DNA oligonucleotide
aatctagagaggataatgcgtaacacacaag

SEQ ID NO: 1002 - DNA, 30 bp, Artificial sequence
  Single strand DNA oligonucleotide
aatctagagattttattcgaggataatgcg

SEQ ID NO: 1003 - DNA, 30 bp, Artificial sequence
  Single strand DNA oligonucleotide
agagctccattaagacatccgatttatttg

SEQ ID NO: 1004 - DNA, 29 bp, Artificial sequence
  Single strand DNA oligonucleotide
agagctcgagacttgtcacacacgtgagg

SEQ ID NO: 1005 - DNA, 30 bp, Artificial sequence
  Single strand DNA oligonucleotide
aatctagacacacacacaaacataaggaaa

SEQ ID NO: 1006 - DNA, 33 bp, Artificial sequence
  Single strand DNA oligonucleotide
aatctagaaacaatacacacacacaaacataag

SEQ ID NO: 1007 - DNA, 30 bp, Artificial sequence; identical to SEQ ID NO: 1003
  Single strand DNA oligonucleotide

SEQ ID NO: 1008 - DNA, 29 bp, Artificial sequence
  Single strand DNA oligonucleotide
agagctcgagacttgtcacacacgtgagg

SEQ ID NO: 1009 - DNA, 31 bp, Artificial sequence
  Single strand DNA oligonucleotide
aatgtcgaccagagtttaatgaagaagcgct

SEQ ID NO: 1010 - DNA, 29 bp, Artificial sequence
  Single strand DNA oligonucleotide
aatgtcgacaaatctaaactttctcagag

SEQ ID NO: 1011 - DNA, 33 bp, Artificial sequence
  Single strand DNA oligonucleotide
aatctagactctctcagaccaaatagttacaag

SEQ ID NO: 1012 - DNA, 28 bp, Artificial sequence
  Single strand DNA oligonucleotide
aatctagaggcaaagacattgattattc

SEQ ID NO: 1013 - DNA, 33 bp, Artificial sequence
  Single strand DNA oligonucleotide
ataagcttattgattcctttaaagacttatgtt

SEQ ID NO: 1014 - DNA, 32 bp, Artificial sequence
  Single strand DNA oligonucleotide
tcgtcgacgggtgtatgtttttaatcttgttt

SEQ ID NO: 1015 - DNA, 2322 bp, Artificial sequence
  Arabidopsis At6669 promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 1016 - DNA, 1545 bp, Artificial sequence
  Cloned Arabidopsis thaliana BDL2
cgtaagacataagcaaaatggccggtggaggattggctcttgatgtctccagcgccggaaacattgatgccaagatcacagccgcagttgtcatgagttgcattgtggctgcctcatgtggtctcatttttggctatgacatcggaatctcagggggtgtgacgactatgaagccgtttcttgagaaattctttccatcggttcttaaaaaagcttcggaagctaagacgaatgtctactgcgtctacgacagccaacttcttacggccttcacatctagcctttatgttgccggcttagtagcttccttagtggctagccgtctcacagcggcttatggtcgccgaaccaccatgatccttggcggtttcactttcctctttggtgctctgatcaatggcttagctgctaacatcgccatgctcatctccggtcggattttgctaggatttggtgtcggtttcaccaaccaggcggctccggtatatctatcggaagtagcaccaccgcgatggcgtggagcattcaacatcggcttttcatgcttcatcagtatgggagtagtagcagccaatctaataaattacggtaccgatagtcaccgtaacggctggcgtatctcgctaggtctagctgctgtaccagccgcgatcatgaccgtgggatgtctattcatttccgacacaccttctagcctcttggcgcgtgggaaacacgatgaagctcacacgtcgctgcttaagctacgtggcgtcgaaaacatagctgacgtggaaaccgagctagcagagttggttaggtcaagccagctagccattgaggctagagccgaactgtttatgaagacgatattgcagagacggtataggcctcatcttgtggttgctgtggtgataccatgttttcaacagttaactggaataacggtgaacgcgttctatgcgccggttctgtttcgatcggttgggtttggttctggtccggctcttattgcgacgttcatactcgggtttgttaatcttggttcgcttcttctctcaacaatggttattgaccggtttggtagacggtttttgttcattgctggcggtattctgatgcttctctgtcagattgcagtggctgtgttactagctgtgacagtgggagccaccggggacggagagatgaagaagggttacgccgtgacggtggtggtgttactttgcatatacgcagctgggtttggatggtcgtgggggccattaagctggcttgtcccaagtgagatattcccactcaagatacgaccagctggtcagagcttaagcgttgccgtgaacttcgccgcaacgtttgctctctctcaaacgttcttagcaacgctctgcgatttcaagtacggtgctttcttgttttacggcggttggatctttacaatgacgatattcgtcatcatgttcttgcccgagaccaaagggatacctgtggattctatgtatcaagtttgggagaagcattggtattggcaacggtttactaaaccgacgtcaacttaaaagatgc

SEQ ID NO: 1017 - DNA, 1165 bp, Artificial sequence
  Cloned Arabidopsis thaliana BDL3
gatgcatggattcaatcaacaagatcatcaacttcttgtttcctctcttaaccttgtatgcacttcttgtcttctacccaacttaccagaggctcaaatccgccgtctccatctgccggaatctgttctcggaaaatgtcgccggaaaagttgttgtcatcaccggagcagcttctggcatcggcgaggctttagcgtatgagtacgggaagaggggagcgtatttagcacttgttgacataagaggagaacctctcttccatgtagcggctctcgctgagctctatggctcccctgaagtcttgcccttagtagccgatgtttccaaactccaagactgcgagcgttttatccgagccacggttcttcattttggacgattggatcatctagtgacaaatgcaggagttgctccactctatttttttgcagacatcgaagatgtctctaaggcttcgccggctatggacatcaacttttggggatctgtgtattgcacattttttgcttctccatacctaaagaagtttagaggaaggattgtggtgattgcttctggatgtggatacattgcttcacctagactaagcttttactgtgtaacattatattttgtatccatttccctctcctaatttactaaccatctgatctcaagcattcatttttgtaccttcatttcatgccgatgaattcaggcgagtaaagctgctgtgatcgccttttatgaaacactaagaactgagtttggatcagatattggggttaccattgtagcaccggggatcgtcgattcggaaatgagccgaggcaagttcatgacaaaggacggtaaacttgtcgtcgataaagagctcagagatgtgcaaatgagcgtattgccagtagaatcagccgagaggtgtgcgaaagcaataatgcggagcgtatgtagaggagataggtacttgttggaacccgactggataggttgtgtcatattgttgaaggttttttgttctgaggcaacagagtgggtagcccggtggctgctgatagccagaccaaaatttccaatgatggaggctcttagcaacaagatccttgatgtagcccatgcctttaattctttcttctcttttcctcattattaggaatatcgatacttgagtctccccgtttatgt

SEQ ID NO: 1018 - DNA, 1572 bp, Artificial sequence
  Cloned Arabidopsis thaliana BDL5
agacatgcacaaagacaacgattcgggttcgggttcgaatccgggtcaggtttcgaactacttgattgttcgaccgcaccgaggtgggtacatagacttgttccggtacggtgtgagagatgaccaaacgagcaaggcaaagttcttggagatgcctgataaccgcgaatggagcacgataacgattgatgaagaagcagaggatcaccgttgggtaatcgtggtttcgattctggttcgtaagattatcagacttctccgaacaccaatggaattcacaggtttcgtcgttgacttcttccttaatctgttctctgcgaatggtgggttcttcggtttgcttctccggttgattcaagcgaaagttgtgataccagaaagaggctctgtgacgtttgttagtacaattgggcaacttgatgggagaattagtctgtataaggaatggaatttcgtcgaacacttggagggcattgactcggttgattctggaagggttaaaatcgaattgggaagtcgtgggcttatggatttgtgtgtgatggcgtctaagcttgcgtatgaaaatgctaaggttgttgaaaacgtcgttgatcttcattggaagatgaatctggtggagttcttggattgttggaatgattatcagaagcagatgtctacacaagtttttgtgtttacggataagcagaaagatgcaaacttgatagtaatcagcttcagaggtactgagccgtttgatgctgatgattggggaacagatttcgactattcgtggtatgaagtccccaatgtgggaaagcttcacatgggtttccttgaagctatgggtttaggcaacagagacgacactaccactttccattacaatctctttgaacaaacctcctctgaggaagagaatagtaaaaagaatcttctggatatggtagagagaagcgcttattatgcagtccgagtcattctgaaacgtttgctttcggaacacgaaaacgctcggtttgtagtcactggtcacagcttaggaggtgctttagcgatactgtttcccacattgttggtgttgaatgaggaaacagagataatgaagaggctgcttggagtttacacgtttggacaaccaagaatcgggaacagagaggtcgggttattcatgaaagctcaactgaatcaacctgtggatcgatacttccgagtcgtttactgcaacgatatcgtcccgagattgccctacgacgacaaaacgttcctctataaacatttcggactctgtcttttctatgacagcttctacaacgaaacaaaagcagaggatgagccggacccgaacccttacggtctgcgttacaagattcttgggcatgtgatcgcagtttgggagttggttagaggcttgacgatggggtacactcatggaccagattacaaagagggatggtttaggatcttgtttaggcttatggggctggtgattcctggtctgtcggatcattgcatgactgattacgtgaactcggttaggcttggacccgataatgaacttcagatgtcctctctttgaaaagtgctctg

SEQ ID NO: 1019 - DNA, 1080 bp, Artificial sequence
  Cloned Arabidopsis thaliana BDL6
caatcatggcagcatcaaaactcctcgtatccgacatcgcctctgtcgttgatcacgtcccttcaaactacgtcagaccagtctctgaccgtccaaaaatgtccgaggttcaaacttccggcgactctattcctctaatcgatctccacgacctccatggacctaatcgagctgacattatcaatcagtttgctcatgcatgctcttcttgtggcttcttccagatcaagaaccatggagtaccagaagaaacgatcaaaaaaatgatgaatgcggcaagagagtttttccggcaatcagagagcgaaagagtgaagcattactcagcagataccaaaaagacaacgagactctccacaagtttcaacgtttccaaagagaaagtctctaactggagagacttccttcgactccattgctaccctatcgaagatttcatcaatgaatggccctcaacaccgatctctttcagagaagtcacagccgaatacgctacaagcgttagagccttggttctgacacttcttgaggcaatctcagagagcttaggtcttgcgaaagaccgtgtaagcaatacaataggcaaacatggtcaacacatggctattaactactatccccggtgtcctcaaccagagctaacttacggacttccggggcataaagatgcaaacttgatcactgttcttcttcaagatgaagtctctggtttacaggtgtttaaagatggtaaatggatcgctgttaatcctgttcccaacactttcatagtcaaccttggtgaccaaatgcaggttataagcaatgaaaaatacaagagtgttcttcacagagcggttgtgaacagcgacatggagcggatatcgataccgacattctactgtccttctgaagatgctgtgattagtccagcacaagagctgatcaatgaggaagaagactctcctgctatttacagaaactttacatatgctgaatattttgaaaagttttgggacacagcatttgatactgagagctgtattgactcgttcaaagcatccaccgcctaagatagtgtactatcgaatcaatcatccg

SEQ ID NO: 1020 - DNA, 1616 bp, Artificial sequence
  Cloned Arabidopsis thaliana BDL7
atgaatatgatgatgcaaaaactctctattctatttctacatttaatattactagtactactctgcgtccatcctctcaccaccgtagccgaccgcaattccaccgattggtgcgacaaaactccataccctgatccatgcaaatgctacttcaagaaccacaacggatttcaacagccgacacaattatccgagttccgagtaatgctggtggaagcagccatggatcgggccatatccgcccgtgccgagttgactaattccggcaagaactgcacggatagcaagaaacaagcagttttggcggattgcattgacctctatggagacacgatcatgcagttaaaccggacattgcatggcgtgtctcctaaagccggtgccgcgaaaagttgcactgacttcgacgctcaaacgtggctgagcaccgcgcttacaaacaccgagacctgccgacgtggctcatccgatttaaacgtcacagacttcatcacacccatcgtttcaaacaccaaaatctcccacctcattagcaactgcttagccgtcaacggagccctcttgaccgctggaaacaaaggcaacaccactgctaatcaaaagggctttccgacgtggctttcccgtaaagataagagactcctgcgtgccgttcgagccaacctcgtggtggccaaggacggatcaggacatttcaacacggtacaagcggctattgacgtggcgggacggagaaaggtgacgtcagggaggttcgttatatacgtaaaaagaggtatatatcaagaaaacattaacgtacgtctaaataatgatgacataatgttggtcggagatggaatgagatccaccattatcaccggcggtcgaagtgtccaaggaggttacaccacgtacaattccgctactgccggtatcgagggacttcacttcattgccaaaggcataacgtttaggaacacagctggtccagccaagggccaggccgtggcacttcgttcatcgtctgacctctcaatcttctacaaatgctcaatcgaaggataccaagatacactgatggtccattctcaacgccagttttaccgtgagtgttacatctatggaaccgtcgatttcatattcggtaacgcggctgctgttttccaaaactgtctcatcctccctcgccggccactcaaaggtcaagccaatgtaattaccgcacaaggtcgtgctgatccgtttcagaacacagggatctctatccataactcaagaatcctaccggctcctgatctaaaaccagtggtcggtaccgttaagacgtacatgggccggccttggatgaagttctcacgaaccgtggttcttcagacgtatttggataatgttgtgagtccagtcgggtggtctccgtggattgaaggttcggtgtttggtctggacactctcttctatgcagaatataagaatactggaccagcttcatccacgaggtggcgtgtcagttggaaagggtttcatgtgttgggtagagcttccgatgcatctgctttcactgttggaaagtttatcgctggtacagcatggctcccacgcaccggcatacccttcacttctggactctaaagacc

SEQ ID NO: 1021 - DNA, 1823 bp, Artificial sequence
  Cloned Arabidopsis thaliana BDL8
cctctgtcttgtcttttggttagtataagtattgataaattcctttgaccagcaagatatcatcactaaaagattttacattaccaagccatctccaatatcatcaggtcggttttctctcgatatcaattggttacgcatgcatctatcatatcttaaagtttattcttctttcattattcttaacccaaattttaatttttatggaacttactaaaacgttgacgatgatccctactgctagtttgttttgaggcatgcattgaaagtactctttgcggtgttccctcatatattacaggtcaagtgatgttgtttctaaccgcggctgtctgtttaatatgcttttacgtctacaagtccgtgaaaccgccgccgccaattccattgccggagaatgtttctgagatatctccaagaatcaagctcaacgatggcagatatttagcttacaaagaattagggtttcctaaagacaaagccaaaaataagattatcattctccatggattcgggagttccaagttagtggatttaaaaatcacacaggtattaataatatgaggattaaatgaaatgattacatgcatatattgcaaactagcttctttacatatcatgataactggagctactatatatgttcctatggctttcaggaaatgatcgacgaattcgagatatacttcttgttgttcgatagagctggttatggagaaagcgatcctcatccatcacgaacactaaaaacggatacatatgacatcgaagaacttgctgacaaattgcaaatcggtccaaagttccatgtcctaggaatgtcactcggggcttatccagtttacggctgtctcaagtacattcctcataggtatatcaatctcttacaagtagaatctaagaataacatttttggtcagatttaattgtgattatcacttagattaaaagctatatatcaaatatactatttatttacacatggatttacgtacatatcatattggcctagtaattatatcttttgaacttataagattaaattgaatatatttcgcatatataaattaaagttcatataatctttacctatgtgaattaatgtctctaacaatatgtatagactaagtggagcaacgttggtggttccgatactgaatttttggtggagttgtctgcctctaaacttgtcgatttcagcgttcaagaaattgccaattcaaaatcagtggacacttggagtcgcacactactttccatggttattatattggtggatgactcagaaatggttttccccatttagtcagaatcctagagaaactatgaccgagcgcgatatagagctcgcggataagcatacaaaacacgcatatattaaggtacctatatagagattgatttttaaaagtttatggagttttagactaaccttgtgttgttttagaccatttttcttatataatgaacttgatgatacattttagtgaaaaaagcacttacgaaagtgattgatttatgtggttcaggaatccgcactacgacaaggtgaatatgtgagcatgcaacgagacatcattgcgggttacgagaattgggagtttgatccaaccgaactgagcaatccattttcagatgataacaaagggtcagttcacatttggtgtgcactcgaagacaaacaaatttcgcatgaggttttactctacttatgtgataagcttccatggataaagcttcatgaagtccctgatgctggacatcttattatccatgagaagcagcattttgaagacattattaaagccgcttgtagttgaagg

SEQ ID NO: 1022 - DNA, 1034 bp, Artificial sequence
  Cloned Arabidopsis thaliana BDL9
cttacaataaaatggtgaaactcgcgacggcgcgtgagattagaacgtacggccctcggcttgggaggagcagagccgagtacatcaacgcaggtctatacttgtttgcaaccgtggtgctcatcggcggtttcacagcgacaggattctcatgggaaccaagatccggcctcgtccttattctcttagctctcgttcttataaccgccgtgaatgttcatgatcttgtggctcatctagctggaatcgattaccggttaaggttaatggagtatgatttgcaactggggctagtggaatttgcagtccctctggttcagatagcgggttcggtagtgtttttcttgggaatctttttcgtcttccatcaggctgagacaaaacgtggatacagtggaagagagcatcatgcattaaacttgctgatagcgggtccgttactttggttgataggatcgattcacaactcatgccaaatctacgagagagcggatagtcatgttcaaattctacagcagtgtgtttacattcctttcttggttggatcccttctattcttggtttccgcagttctcaatagcctcgacatatccgggtcatctcgtagtggattgaagcttcttggggaaagatggatttggcttgggatttccggggctatatgtttgtttgtgggaggattgctgaacgttgttaaggtttttaacttcgtccagatctctgggctccgcctcgagaaactacggggtggagctcaagaccgacttcttgaagggagagaaggatatctccctcttgttgctgaagaagaaagaataaggaaaatggaagctgatcacgaagcttctagtagagccaaaccccgggcacacacaacctccaaagccggagagggagctacagagaccgtggtggtatcatctccgacaccatacaaggatgttctcgttggacagatctgaggaagattagtcatgtttaaatgttcttttgtactccatatttgtttttagctgcggagaccacatattttg

SEQ ID NO: 1023 - DNA, 370 bp, Artificial sequence
  Cloned Arabidopsis thaliana BDL12
gttctatccccaactctaaatgctaaaatggtgacttacccgaatggtgatagacactgtgtaatggcccaaggccaagtgataagtgcatgcttgcaacaagccaacggactaccacatgcggattgttgctatgccataaacgatgtaaacagatatgtagagacaatctacggtcgtttagctctttgcaaatgtttccaggaaattctaaaagattctcgatttacaaaacttattggtatgcctgaaaaatgtgccattcctaatgctgtgccttttgaccccaaaacggattgtgacaggtttgtagaacatatttggcttaaaatgttttgaattatttgcactatctcgatagaactttaag

SEQ ID NO: 1024 - DNA, 201 bp, Artificial sequence
  Cloned Arabidopsis thaliana BDL14
atggatctacaacagtccgaaacagatgataaacagcccgaacaactagttatttacgtctgcggagattgtggacaagagaacattttgaagcgtggagatgtgttccaatgcagagattgtgggttccgtattctctacaagaagcgtattctcgacaagaaggaaacccgtatagtttaatacccagctgtctgagtg

SEQ ID NO: 1025 - DNA, 846 bp, Artificial sequence
  Cloned Arabidopsis thaliana BDL15
aaaggaatatgagaatcagctgcaacgggtgtagggttctacgcaaaggttgcaaccaagattgcaccattcgaccatgccttcaatggatcaaatccgcagactctcaagccaatgctacactcttccttgctaagttctacggtcgagccggtcttcttaacctcatcgaatccggtcctgatcaccttcgtcccgcaatatttaggtcacttctgtacgaggcttgtggtcggatcgtgaaccctgtagatggttcggttggtttgatgtggtcagggaactgggctcagtgccaagcagctgttgacgccgtgctcaacggcttacccataactcacacacctcttccaagtgcatccgcgtcgcaccagatcattcctccccacaggacttacgatatacgccacgtggctaaagatccaacaaccggcggcgacagttcggagaatctggccacacgtgtaaacgctaacaagagcaagacgcaaactggccgattcaaacgtgaatccgtgaaccaactaggtgaatgtagtcatgacatgtggcaactcccaagttctagtgctacgcatggttatggccacttcacgttggagaatgtggagagccgaagggaagctccatttaatcaaagttctccaaatcttgggtttgatgatcaagtcgatatcaacgaggttggcttagagctcagacttggttagaaccagaagattgcattattattatcataattctgtctttttaattaataatttcactttctatataaaaggagaaaaaaaaactaaagcaaatcaaatttagtattattgtcaatcattaggttatcataaactc

SEQ ID NO: 1026 - DNA, 2768 bp, Artificial sequence
  Cloned Arabidopsis thaliana BDL16
atgtccaccgttaatcatcactgcctcctcaattttcctcatatcccaccttcaattcctccgaatcatcgtcccaaacttctttcttctctctccctctatcgaaaaccagaacgcctctttgctctctctgcgtctctgtctctttcaccagcaacaatccatgaatgttcttcttcctcatcttcttcttcttcatcgttcgataaagaagaaacggaagacattgaatctgttattgatgggtttttctatctgcttcgattgtctgctcaataccacgacgtcgaggtaacaaaagctgtgcacgcttcgtttcttaagctcagagaagaaaaaacccgtcttggaaatgcccttatctctacttatctcaaacttggtttccctcgtgaagctattctcgtcttcgtgtctctgtcttcgccaacggtggtttcttacacagctcttatctcgggtttctcaaggttaaaccttgaaattgaggctcttaaggttttcttcaggatgagaaaagcaggtcttgttcagccgaatgagtatacttttgtagcgattttgactgcttgcgtgagagtttcccgattctcgcttgggattcagattcatggattgatagttaaatcagggtttttgaattctgtgtttgttagtaattcgctgatgagtttgtatgataaggattctgggtcttcgtgtgatgatgtgcttaagttgttcgatgaaattcctcagagagatgtggcgtcttggaacactgtggtttcgagtttagtgaaagagggcaagtctcataaagctttcgatttgttttatgagatgaatagagtcgaaggatttggagttgatagttttacgctttcaacgcttttgagctcttgtactgattctagtgtcttattgagaggtagagaactccatggtcgtgcaattaggatagggttgatgcaggagttgagtgtgaacaacgctctgattgggttttattctaaattttgggatatgaaaaaggtagagagtttatacgagatgatgatggcgcaagatgctgttactttcacggagatgatcacagcttacatgtcatttggaatggtggattccgctgttgagatattcgcgaatgtaactgaaaaaaacactattacgtataatgcgctcatggctgggttctgtagaaatggccatggcttgaaggcactaaaattattcactgatatgctgcagagaggtgttgagttgacggattttagtttaacaagcgctgttgatgcttgtggtttagtttcagagaagaaagtaagcgaacagattcacgggttttgtattaagtttggaactgctttcaacccttgtatccagactgcattgcttgatatgtgcacaaggtgtgaaaggatggcagatgctgaggagatgtttgaccaatggccttctaatctcgatagctcgaaagcaacgacgtctataatcggtggttacgctcggaatggcttacctgataaggctgtatcgctattccatcgcactctctgtgaacagaagttgtttttagatgaagtttcgttgactttgattcttgcggtctgcgggacattaggttttcgggaaatgggttatcagatccattgctatgctcttaaagctgggtacttttctgatataagcttgggaaattctttgattagcatgtacgcgaaatgttgtgactcagatgatgccataaagattttcaacactatgcgagaacatgatgttatttcttggaacagcttgatttcttgctacatccttcaaagaaatggtgatgaggcactggctctatggtcgaggatgaatgagaaagagatcaagcctgacataatcaccctcactcttgttatttctgcatttcggtatacagagtcaaataagcttagtagctgccgtgatctgtttctctccatgaagactatctatgacattgaaccaacgactgaacattacactgcattcgtccgtgttcttggtcattggggtcttcttgaagaagcggaagacacaataaactcaatgccggttcagcccgaggtctctgttttgagagctctgcttgatagctgcagaatacattcaaacacaagcgttgcgaaacgagtagcaaagcttatactatctacaaagccagaaaccccgtctgagtacatcctcaaatccaacatctactcagcttccggattctggcatcgctctgaaatgataagagaggaaatgcgggaaagaggttaccggaaacatcctgctaaaagctggataatccatgagaacaaaatacattcctttcacgcgcgtgacacatcccacccgcaagagaaagacatatacaggggattggagatactgataatggaatgtctgaaagttggatacgaaccaaacacagagtatgttcttcaggaggttgatgagtttatgaagaagagtttcttgtttcaccacagcgcgaaactcgcagtgacttatggaattctctcgagcaatactcggggcaagccggttcgggttatgaagaacgtaatgctctgtggtgattgccacgagttcttcaagtatatttcagttgtggtaaaaagagagatagttttgagagattcctcagggtttcatcattttgtgaatggcaagtgttcttgtagagatctgtggtgaatcgaccaagacccttagtttttgtaatgttttcttttataaattcgtaagttgttaatacgagagttttggttctg

SEQ ID NO: 1027 - DNA, 641 bp, Artificial sequence
  Cloned Arabidopsis thaliana BDL18
tacaatggcggatacacaccgtgtcgaccgtactgatagacactttcaatttcagtcgccctatgaaggcggccgaggtcaaggtcagtatgaaggtgaccgtggttacggtggtggcggttacaagagcatgatgcctgaaagtggcccatctagtacccaagtattgtccctgttgattggagtccctgtcgtcggttcgctacttgccttggctggattacttctagctggttcggtgatcggcttaatggttgctttaccactatttctcctcttcagcccggttatagtcccagcggctctaactatcgggcttgcaatgacaggctttttagcctcggggatgttcggtctaaccgggcttagctcaatctcatgggtcatgaactatcttcgtgggacaaggagaactgtgcctgagcaattggagtatgctaagaggagaatggctgatgcggttggctacgcaggacaaaagggcaaagaaatgggccagcatgtgcagaacaaggcccaagatgttaaacaatatgatatttctaagccacatgacactaccactaagggtcatgagactcaggggaggacgacggctgcatgatgagttttcagtatgaacggtagatatgtgttttcac

SEQ ID NO: 1028 - DNA, 3383 bp, Artificial sequence
  Cloned Arabidopsis thaliana BDL19gD NA
agagagagatagggctttgaggtttgtgtttgtattataatacataatatataggaatagtgtcttcttcttcatcatcatcttctatctcatcatcatcatcatgcatcatcttcttcttggttctttctttagctccgatttatagcttttaattttgactattttttttccttcttctacttggtttctttctcttgatctcaggtacaagaaaaatacaacttagaaatctttcctcttaattctttcaaaagtttaggaacaaaaaacaaaagtataaactcttaatttgtttttctttgtttatgtcttctagtgaaatggtttttataaaatttcttcatgtcgtcaatctctatggatttttcctgttcttataattcctcccttcgttttcttcttaacttttttgtcttacgaattatttgtagattattctcttccacgcaaagaagaagatctaaagatgtcgtcatcatcatataacacaagcgttattccttcatcatcatcctctgctcagcctttcttcatcaccagctccggcaccggagataacgactttaaccggaaagatacttttatgtcaatgattcaacaacctaactcctcagctccaccacccaagaaacgaagaaaccaacccggaaacccaagcaagtatctcttacatataaatctctatatatttatcacctttctataagaatcactatatataagctttaagataataccaagaagaaaaagaaccctaatcatttgttctattttgttttgtatatctagctagtatcaagatttcatatatattgacaggccagtatatcttatatgtttatacgtgtatatgtcatttgatttatgtttacatgtgtgtgtatcatttttttcgatatagtctacatagattgacattttgggtctaattggtgacttaatttaaatgattaaattctttaattatatgaaacagatcctgatgcggaagtggtagcattatctccaaagacactaatggctacaaacagattcatatgcgatgtatgtaacaaagggtttcaaagagaacaaaatctacagcttcaccgaagaggacacaatctcccatggaagctgaaacaaaaatcaaccaaagaagtgaagaggaaagtgtatctttgtccggagccaacgtgcgttcaccatgacccgtcacgtgctctcggagacctcaccggaatcaagaagcattattaccgtaaacatggcgaaaagaagtggaaatgtgagaaatgttctaagcgttacgctgttcaatcagattggaaagctcactctaagacttgtggtactaaagagtatcgatgtgactgtggtaccatcttctctaggtaactaatctctatccatttcatttaaataatttgttcgtatttgatttaagtgatgaaacgtataatatatgtgtcagtgtgtgtggcatctagatataccttcttatcttggtaaagtataacaattaatggaccacctttattttgtattataatgcaaaactattctaagtaaaagctgcattcaacactgcatgtaaaacttagcttatttactaatttacatggaaaataccaaatatatataaccatctgtgactgaaatattgtatatttggccacggaatttgaacctcgagtacaccgcctataaattgtatgtagtcacaatgtacataggatctatcaatgtatttgtttggttgttgatgagtagtgaatagagaaagacagtgaatagaaagtaagaaaatttaaaagatgctaaatttggtcacatactcacatgcatgagttggattttgtttttctattttctacttttgttttcttcttcttcactttgcaggttcccctttttacgaaactcctcttcatttgtggaccctcttcttatctctttctctctctatgtatgtttatatatacgtacatagatacatacatatttggtaagagtgcgttacttatatttattacagtgttctggtgaacactttaatgctcttctagggtttctttctatattttcatggtttgagtaatatacgttgttgcagaatgtgactgacttatattaacattcatgggttttgcattaaatgaagaaggtctttcactaaattagcaattgactcgacctctatattcttctttcattctctcctttaaatggtagccacaataactatagcatttattgattatgactcacggaataaatatagtataaagttttcatatatatgaattaataactttattatcgaccgttgtgttatttacatttctttttgttttgctttgtagacgtgatagttacatcacgcatagggctttctgcgatgcattgatacaagagactgcaagaaaccctaccgtgagctttacgtcaatgacagctgctagtagtggtgtcggctccggcggaatctacgggagacttggcggtggcagtgctctctcacaccaccatttgagtgaccatccaaattttggatttaaccctctcgtgggttacaatctgaacattgcatcttctgataataggagagactttattccgcaatcatcaaaccctaacttcctaatccaaagcgcttcgagccaaggaatgttgaatacaacgccaaacaacaataaccagagtttcatgaaccagcatggtctgatacagtttgatccagtcgacaacatcaacctcaagagtagcggcaccaacaacagcttcttcaacctcggattctttcaagaaaacacgaagaactcagagacgagtcttccttctctatatagcaccgacgttcttgttcatcaccgtgaagaaaacttgaacgcgggttctaacgtgtcagccacggcactacttcagaaagctacacaaatgggttcagtcacaagcaacgacccatctgctttgttcagaggcttagcttcttcgtctaactcatcaagtgttatcgctaatcactttggtggaggacgaattatggagaatgataataatggaaaccttcaaggtctaatgaactcattagccgccgttaatggaggtggcggatccggtggcagtatcttcgacgttcaatttggagacaatggaaatatgagcggctcggacaagttaacgttagattttcttggagttggaggaatggtgagaaatgtaaatcgcggtggtggtggtggtggtcgcggcagtgctcgtggcggagtttctttggatggtgaggcgaagtttcctgagcaaaattatccatttggaagaggttgataatatcttattattgtataacttaattaggtgataattttgttatcttcgcttgttgttttcataatcac

SEQ ID NO: 1029 - DNA, 324 bp, Artificial sequence
  Cloned Arabidopsis thaliana BDL20a
agagacaaagaagttggccatggcaacgaagtcagtttctaccttcgccatctttttcatcctcgttttggctatctttgaaactcctgagatagaagcgtatgataggaagtgcctgaaagaatacggcggcgatgtgggtttcagctactgtgcacctcgaatattcccgacgttctgtgatcagaactgccgtaagaacaagggcgcgaaaggtggagtatgccgttgggaagagaacaacgctattggtgttaaatgcttatgcaacttctgcagcgaggaaccctctgatcaaactctaagtcgtatttgaatcttgca

SEQ ID NO: 1030 - DNA, 966 bp, Artificial sequence
  Cloned Arabidopsis thaliana BDL21
aagcatgtttaaactctgtctcgttctcgtcttggttattgcagtagatgcaaatccggctaagtccggttcttgtagttgctccgggaatatatcagcgagcgatgtcgatcgagttcatttcgcgatgaacttggagttcaccgaggccgagttcttcttaaaaggggctaccggaaaaggacttgatgcctataacgcgacacttgctaaaggcggaccaccgccgataggggccaagaaagccaaccttgatcctataactaatcgaatcatcgaggagtttggttatcaagaaatcggtcatcttagggcgattacggatatgacgggaggaattccacgtccgctaataaatctgacgagagagaatttcgcagtgtttatggatagagcggttggacgcaaatctaatccgcggtttgatccttacgccaactcactcaactatctcttagcttcatattatatcccttatgttggccttaccggttatgtcggaaccatcccttaccttgtctacttcaatatcaaaaagctagtggcgggtctattgggggtggaatcgggtcaagacgcagtgataagaacgcttctgtacgagagacagaatgagaaggtggaggaatacggtggagtcacggtggctgagctgaccaatgagatatctaacctccgtaatgaactcggtatgtgcgggatcaaggacgaaggcttgtgcgtgccgttgtggctaggagcggagaatcgcaccaccagcaacatcctctccgctgatccttactctctctcttatgaccggacagcacaagagatcctcagggttatgtacggcaccggtgatgagcaccgacctggcgggttttggccgtgtggtgccaatggaaggatcgctaggatgtttcttgatgaagggtgttatggtgaatattgcgttgtatgttcacatgacaattaaaagtttcc

SEQ ID NO: 1031 - DNA, 1351 bp, Artificial sequence
  Cloned Arabidopsis thaliana BDL23
catcataatcatatggagttcgagtcagtgttcaaaatgcattatccgtatctcgcagccgttatctacgatgatagctccactttaaaagattttcatccatctcttaccgatgatttttcttgtgtacacaatgtgcatcacaaaccatcgatgcctcacacatatgaaataccatcaaaagaaaccattaggggcatcactccttctccatgcactgaagctttcgaggcatgttttcatggcacatccaacgaccatgttttttttggcatggcctataccaccccaccaactattgaacccaacgtttcacatgtctcacatgacaatactatgtgggaaaacgatcaaaaccaaggattcatctttggaaccgagtcaaccctcaatcaagccatggcggactctaatcaattcaatatgccaaaaccactcttgagcgcaaacgaagacaccatcatgaatcgacgtcaaaataaccaggtaatgatcaagaccgagcagatcaagaagaagaacaagagatttcagatgaggaggatatgtaaacccacaaaaaaagctagcatcatcaaaggacaatggactcctgaagaagacaagttattggtgcagctagtggaccttcacggaactaaaaaatggtctcagattgctaagatgcttcaaggacgagttggaaaacagtgcagagaaaggtggcataaccatctccgtcccgatatcaagaaagatggatggactgaagaagaggatataatactgataaaagcccataaggagattgggaacagatgggctgagatagctcgaaaactcccgggacgcactgaaaatacgatcaagaaccattggaacgcgactaaacgtcgacaacactcgaggaggactaaaggaaaagatgaaatttccctttcacttggtagcaacactcttcagaactacattaggtctgttacctacaatgatgatcctttcatgaccgcaaatgcaaacgcaaacattggtccaagaaacatgagaggtaaaggtaagaatgtaatggttgcggtctcggagtatgatgagggtgaatgtaagtatattgtggatggtgtgaataacttgggtttagaagatggaaggatcaagatgccgtcattggcggctatgtcggcctccggatcagcgtctacttctggttctgcgtctggttctggaagtggtgtgaccatggagattgatgagccgatgactgatagctggatggtgatgcatggatgtgatgaagttatgatgaacgagattgctttgctggagatgattgctcatggtcgtctttagaccgtgcaatataaacaagtcgaac

SEQ ID NO: 1032 - DNA, 1103 bp, Artificial sequence
  Cloned Arabidopsis thaliana BDL25
ctccgagactgtctccgattgaatgggaattgaagacatgcattcaaaatctgacagtggtgggaacaaggttgattcagaggttcatggtacagtatcgtcgtcgataaatagtttaaacccttggcatcgtgctgctgctgcttgcaatgcaaattctagtgtggaagctggagataaatcttctaagtcaatagcattagcattggaatcaaacggttccaaatcaccatccaatagagataatactgttaacaaggaatcacaagtcacaacgtctccacaatcagctggagattatagtgataaaaaccaagaatctctgcatcatggcatcacacaacctcctcctcaccctcaacttgttggccacacagttggatgggcatcctcaaatccataccaggatccatattatgcaggagtgatgggagcctatggacatcatcccctggggtttgttccatatggtgggatgcctcattcaagaatgccactgccgcctgagatggcacaagaaccagttttcgtgaatgctaaacagtaccaggcgattctgaggcgaaggcaggcacgcgccaaggcagaactagagaagaagctaataaaatccagaaagccttatctacatgaatctcggcatcaacatgctatgaggaggccaaggggtactggaggacggtttgcaaagaaaaccaacaccgaagcttcaaagcgtaaagctgaagaaaagagcaatggtcatgttactcagtccccgtcatcatctaattctgatcaaggtgaagcttggaatggtgactatagaacacctcagggagatgagatgcagagctcagcttataagagaagggaagaaggagagtgttcagggcagcaatggaacagcctttcctcaaaccatccttctcaagctcgtctagccattaaatgacctcacaaggcggcaattcattcttggctttctctttgttggcttattcggtagcagccatgaaagagtattttctctcgtttttttttcttctgattttgtacaaatactttttgtagctttttgtgactttttccctttcagtttggaatacttcagatgttgccac

SEQ ID NO: 1033 - DNA, 1634 bp, Artificial sequence
  Cloned Arabidopsis thaliana BDL26a
tcattacagtgactctgcatgcttcagactgatttcagcaacatgcatgggcttaaaatcagcttctaagactgagatttagtgaccagtgtggtggtgtcttgttctctgttcttgggagaacacaaaggcagtgtggagtctggtaaaatatgatacatggtttgccatctatgaagtctatcaaatcattgaagtcacttgttaaaagaaaaaccaatgctcaagaagtgagtaaatccgggtggaaaatgaagccctttttggctctcatgtgtacagctcttttgatcttttggtataagaccacaaatattcagtttgaacaaacagagatagaagaaacagattatccttttgacatggctaaggaatctgaagcagttaacgataaattaaaaggcttgcctcgtggaatcatacagtctagatcagatcttgaattaaagcctctctggtctagaggtagtctgaggtcaaagggtgtggaaatgactaaccgtaacttgttggcaatacccgtaggacttaagcaaaagggtaacgtcgacgctcttgtaaagaagtttcttcccgcgaatttcacgattgttcttttccattatgatggaaatatggataaatggtgggatctggagtggagttcaaaatccatacatatagttgcacaaaaccagactaaatggtggtttgcaaaacgattcctccatccggatgttgtatccatttatgattatatttttctttgggacgaggatcttggagtagagaatttcaatccagagagatatttgaagatagttaaatcagtgggactggagatatctcaaccggctttggaccacaactcgactgaaatacaccataaaatcactctccgttctaaaacaaagaaatttcataggagagtttacatcaatagaggccataaaagatgttctaatactagctcagatcctccttgcaccggatttgttgaaggaatggctccggtgttttcgaaagctgcttggctttgcacttggaatcttatacagaatgatttggttcatggatggggaatggatatgaaacttgggtactgcgcacagggagaccgaacgaaaaacgtagggattgtggatagcgagtatatccttcatcaaggcattcaaactttaggtgaaagtgttcctgagaagaagaagacggctcgtgatgttgggaccaggagacaaggccatacaacttttgattcaagaaccgagataaggagacaatcgacatgggagcttcaaacttttaaagaacgatggagcaaagcggtagaagaagacattaagtggatcgatccatcgtcatcaagctcgatgacaaagaggaagagtaacggtaataacagaagattaaggcgtggtagtagtagtagtcaccgagtaaagcataagagaagtcaagagacatcaagaacaacaacaacacacaaatagcaagagaaggattattatacacatagatagtgtttttctttatctcattaaccaatttatatatgattatactacttatccttagttagtatatagctttcttggaattgatgaaaaagggttcatattaagatttgtaaaagctcatgtccattatgtactttc

SEQ ID NO: 1034 - DNA, 1772 bp, Artificial sequence
  Cloned Arabidopsis thaliana BDL26b
gtaatattaccataaggttcagaagtaaatttttctaaaattgttttcttgtgggaaattcagactgatttcagcaacatgcatgggcttaaaatcagcttctaagactgagatttagtgaccagtgtggtggtgtcttgttctctgttcttgggagaacacaaaggcagtgtggagtctggtaaaatatgatacatggtttgccatctatgaagtctatcaaatcattgaagtcacttgttaaaagaaaaaccaatgctcaagaagtgagtaaatccgggtggaaaatgaagccctttttggctctcatgtgtacagctcttttgatcttttggtataagaccacaaatattcagtttgaacaaacagagatagaagaaacagattatccttttgacatggctaaggaatctgaagcagttaacgataaattaaaaggcttgcctcgtggaatcatacagtctagatcagatcttgaattaaagcctctctggtctagaggtagtctgaggtcaaagggtgtggaaatgactaaccgtaacttgttggcaatacccgtaggacttaagcaaaagggtaacgtcgacgctcttgtaaagaagtttcttcccgcgaatttcacgattgttcttttccattatgatggaaatatggataaatggtgggatctggagtggagttcaaaatccatacatatagttgcacaaaaccagactaaatggtggtttgcaaaacgattcctccatccggatgttgtatccatttatgattatatttttctttgggacgaggatcttggagtagagaatttcaatccagagagatatttgaagatagttaaatcagtgggactggagatatctcaaccggctttggaccacaactcgactgaaatacaccataaaatcactctccgttctaaaacaaagaaatttcataggagagtttacatcaatagaggccataaaagatgttctaatactagctcagatcctccttgcaccggatttgttgaaggaatggctccggtgttttcgaaagctgcttggctttgcacttggaatcttatacagaatgatttggttcatggatggggaatggatatgaaacttgggtactgcgcacagggagaccgaacgaaaaacgtagggattgtggatagcgagtatatccttcatcaaggcattcaaactttaggtgaaagtgttcctgagaagaagaagacggctcgtgatgttgggaccagggtaagttgtatcgactcaaaaacattctcgattctaattcttttggtcttcactaaataaaactcactccttcgtgtttcttttttttgtcgatatttcaagagacaaggccatacaacttttgattcaagaaccgagataaggagacaatcgacatgggagcttcaaacttttaaagaacgatggagcaaagcggtagaagaagacattaagtggatcgatccatcgtcatcaagctcgatgacaaagaggaagagtaacggtaataacagaagattaaggcgtggtagtagtagtagtcaccgagtaaagcataagagaagtcaagagacatcaagaacaacaacaacacacaaatagcaagagaaggattattatacacatagatagtgtttttctttatctcattaaccaatttatatatgattatactacttatccttagttagtatatagctttcttggaattgatgaaaaagggttcatattaagatttgtaaaagctcatgtccattatgtactttc

SEQ ID NO: 1035 - DNA, 1208 bp, Artificial sequence
  Cloned Arabidopsis thaliana BDL27
ctcttacacatgtatcggtagttggaaatgccgacccaaaaggaccaaaactcaccattatctcaagtgatagagcttctcaagaaactactccaccatttccacaatctccttttgtatttcttcatcctctggatcggcgtgatagttggaatcattgtttatccctctctacaaggattatcttcgccttcttcgttaaccatccaaagtgtctcccaactcttctttgtaacccctcctcctcctattctttctccttcatttcaggacaatgggcttgacatgtttctgataccactgaagaacatcatgcacgatatggaagataatgaacttctgtggagagcttcaatggatcctaagatcagggattacccttatcctagaatcccgaaggttgctttcatgttcttgacttggggacctttacctttggctcctctatgggaaaggttctttcgaggtcatgaaggtcttttcactatctacgttcacaccaattcgtcttacgacgagttcatgccgcaagactctgtgttttatggccgccgtattccaagcaagagagtggattggggaaacgcaaacatggtagaagcagaacgaaggttattagcaaacgctttattagacatcaacaacgaacgtttcattcttctctccgaatcatgcatccctctcttcaacttctccacagtttactctttcctcatcgactccactctaacccacgtcgactcctacgacctcacaatcggtcgcgtccgctatgaccgccgcatgtatcctcacatccgcatgcaccaatggcgaaaaggctctcagtggttcgagctagaccgagccatggccctcgaggtagtctctgatacgttctactggccaatctttaaagcttactctcgctgccccgacgagcactatatcccgacgctactcaacatgaggccgagccttgggttgcgtaacgcgaataggacgcttacttggactgactggagcaagcgtagggctcacccgagattgtttggtgagtgggaggttaatgtggagttcttggagtggctaaggatgaagagtgttggtgattgtaagaaaaatggagaaaataagatgagactttgctttctctttgctcgcaagttttcgtcgactgctttggatgagttactccggttagcatctatcgtcatgtatttctgatc

SEQ ID NO: 1036 - DNA, 1146 bp, Artificial sequence
  Cloned Arabidopsis thaliana BDL28
gagagatggctaaatcagatatgttgccgttcttggcgatggtgttggtgcaaatcggctacgcaggcatgaacattacgtcgaagatggctatggaggccggtatgaagccactcatcctggtcgcttatcgtcagatatttgccactatcgccacttttccggtcgcattttttctcgaacggaagacaagaccgaagatcacacttaggattcttgtccaagtcttcttctgctccattactggtgcgactggaaaccaagtgctatatttcgtaggacttcagaattcatctccgaccattgcttgtgccttaactaatctcttaccagcggtcactttcctcctcgccgcaatattcagacaagaaaccgtggggatcaagaaggcatcaggacaagccaaagtgatagggacgctagtatgtgtgatcggagccatggttctctccttctaccatggtcacaccatcggcattggagaatccaagatccattgggcctacgctgaaaacatcacgaaacatggttccagttctggccattctaatttcttcttgggaccttttcttattatggctgctgccgtttcttgggccgcttggttcattatccagacgaagatgagtgaaacatttgcagcaccgtacacgagcacactactaatgtgtttgatgggaagtatccaatgtggagccattgctttgatctccgatcatacaatctctgattggtctctcagctctcctctccgcttcatatccgccctttatgccggagtggtggcgtctgcgttagctttctgcctaatgtcatgggctatgcagaggaaaggtcctctgtacgtctctgttttcagccctttacttctcgtagttgtcgccattttcagctgggctcttcttgaagagaaactctacaccggcacgtttatgggatcagcacttgtggttattggtctctatggcgtattgtgggggaaagacagagaggtgagtgagaaggaagaagaaagggagaaggtgaaacaacaaaaccataaagtcaagagtgaaagtaatgaagatattgaatcgagattaccggtagcaagtagtggaaatggttccacaaggtctacatcgccttaaaatggtgattgcttct

SEQ ID NO: 1037 - DNA, 559 bp, Artificial sequence
  Cloned Arabidopsis thaliana BDL29
gatttcttctccttaagccatggaattgcccccaaaagtgaaaaacatcttgcttttggattctgaaggaaagcgtgtagcggttaagtattactcagatgactggccaacaaattcagctcaggaagcgttcgaaaaatccgtgtttacaaagactcagaaaacaaatgctaggaccgaagtggaagtgacagcactggagaacaacattgttgtgtacaaatttgtgcaagatctccatttctttgttacgggcggtgaagaggaaaacgagcttatcttagccagtgtgcttgagggactctttgatgcagtgacccttctccttagaagcaatgttgataagagagaggcactagacaaccttgatctcatctttctaagctttgatgaaattatcgatggcggtattgttctggagacggatgcaaatgtaatagcaggtaaagcagggatcaatagcactgaccctaacgctcctctatccgagcagacgataagtcaagcactcgcgactgcaagagaacatttgacaaggtcacttatgaaatgatgtgtg

SEQ ID NO: 1038 - DNA, 1363 bp, Artificial sequence
  Cloned Arabidopsis thaliana BDL32a
gaggataatgcgtaacacacaagttatctatgttatatattattaggagagacttttctttactggaacggaacatagccaaggatatgcatctcagatcctgaacttgcaaaaactatgttgtcgaacaagttaggtttctttgtcaaatcaaaggcaagacctgaggctgttaaacttgtcggctccaaaggacttgtctttatcgaaggtgctgattgggttcgccatagaagaatcttgaaccctgctttctccatcgataggctcaagatcatgacgaccgtgatggttgattgtacgctcaagatgttagaggagtggagaaaagagagcactaaggaagaaacagagcacccgaagattaaaaaggaaatgaacgaagagttccaaagactaacagctgatataatagcaacctctgcgtttggaagcagttacgtcgaaggaatcgaagtgtttagatcacaaatggagcttaaaaggtgttatacaacttctctcaaccaagtctctatccctggaactcagtaccttcctacgccttcgaacattcgggtatggaagctggagaggaaaatggataactcaattaagagaattataagttcgagactacagtcaaagtcagattatggagacgatcttctcggaatcttgttgaaagcttacaacactgaagggaaggaacggaagatgagcatcgaagagatcatacatgaatgcaggactttcttcttcggaggtcacgaaactacttcgaatttattggcatggacaacgatgttgctgagcttgcaccaagattggcaggagaaactcagagaagagatattcaaagaatgcggtaaagaaaaaaccccagattcagaaactttctccaaactcaagctgatgaacatggtgatcatggagtcgcttcgactttacggaccagtgtcagctttggcccgagaagcatcagtaaatataaagttaggtgacctagagattcccaagggcacaaccgtagtcatcccgcttctgaagatgcatagcgacaagaccctttggggatccgacgccgacaaattcaacccaatgcggtttgcaaacggcgtttcccgagccgccaatcacccaaacgctctcctagcattctccgtcggaccaagagcttgcattggccaaaactttgtcatgatcgaagccaagactgtgctcaccatgattcttcaacggtttcggtttattagcctctgtgacgagtataagcacacccctgtggataacgtcactattcagcctcagtacggcttacccgtaatgcttcagcctctggaagactgaagtaaaatgcccaaataaatcggatgtcttaatg

SEQ ID NO: 1039 - DNA, 1629 bp, Artificial sequence
  Cloned Arabidopsis thaliana BDL32a
cacacacacaaacataaggaaaaaaaaacttttccatggggctcgtaattttcttggcactaattgtcttaatccttattattggtctcaggatattcaaagcttttatgattcttgtttggcatccatttgtgttgaccagaagactcaaaaaccaaggaatctcaggcccaaattacagaatcttttacggaaacctcagcgagataaagaagatgaagagagaatctcatctttcgattcttgatcctagctccaatgatattttccctcgtattcttcctcattatcaaaaatggatgtctcaatacggagagacttttctttactggaacggaacagagccaaggatatgcatctcagatcctgaacttgcaaaaactatgttgtcgaacaagttaggtttctttgtcaaatcaaaggcaagacctgaggctgttaaacttgtcggctccaaaggacttgtctttatcgaaggtgctgattgggttcgccatagaagaatcttgaaccctgctttctccatcgataggctcaagatcatgacgaccgtgatggttgattgtacgctcaagatgttagaggagtggagaaaagagagcactaaggaagaaacagagcacccgaagattaaaaaggaaatgaacgaagagttccaaagactaacagctgatataatagcaacctctgcgtttggaagcagttacgtcgaaggaatcgaagtgtttagatcacaaatggagcttaaaaggtgttatacaacttctctcaaccaagtctctatccctggaactcagtaccttcctacgccttcgaacattcgggtatggaagctggagaggaaaatggataactcaattaagagaattataagttcgagactacagtcaaagtcagattatggagacgatcttctcggaatcttgttgaaagcttacaacactgaagggaaggaacggaagatgagcatcgaagagatcatacatgaatgcaggactttcttcttcggaggtcacgaaactacttcgaatttattggcatggacaacgatgttgctgagcttgcaccaagattggcaggagaaactcagagaagagatattcaaagaatgcggtaaagaaaaaaccccagattcagaaactttctccaaactcaagctgatgaacatggtgatcatggagtcgcttcgactttacggaccagtgtcagctttggcccgagaagcatcagtaaatataaagttaggtgacctagagattcccaagggcacaaccgtagtcatcccgcttctgaagatgcatagcgacaagaccctttggggatccgacgccgacaaattcaacccaatgcggtttgcaaacggcgtttcccgagccgccaatcacccaaacgctctcctagcattctccgtcggaccaagagcttgcattggccaaaactttgtcatgatcgaagccaagactgtgctcaccatgattcttcaacggtttcggtttattagcctctgtgacgagtataagcacacccctgtggataacgtcactattcagcctcagtacggcttacccgtaatgcttcagcctctggaagactgaagtaaaatgcccaaataaatcggatgtcttaatg

SEQ ID NO: 1040 - DNA, 755 bp, Artificial sequence
  Codon optimized synthetic BDL-1 coding sequence
ggatccgtaccatgtctcagactatggaagagtaccagtctaacgagtctgaggataagaggtcttggatctggtctaaggctgtttctgtgggaaagaaggttttgactgctggggttgtggtttcttctgctcctcttctcgtgccatctcttttcgtggcttctactctcgctttcctctcttctgttccattctgcctcttccttgctaactacgcttgcacccaaaaggttatgtctaccctccttccagataccgaggaaacaggtggtgtgggaaaggaagatgatgatgagtcaggtttcgatgagtactctaagatcggacatggtgaaggtgctgctggtgttggagaagcagctttgttcagaggaaaggaagagccaatcccaatccaagtcaaggaagatgaagaaatggctaaggaatctacctctctccttgagaagatcagagatgagggaaggactgataaggaaaccagtgagaggactctccaggatgataagaagtctgggaacgcaaagtctgaggaagtgcaagagcaaccagagaagagagaggctccagagactagaagagagggtgaaacaggggcaactaagatcgagacttctaccggaaaggatgatgaagagatcagttcaaacgagccaatcgatcaggcttctggtgctcaaggtactggtgaagagaagaggaagaacaccaccaagaagaagaagaaaactggaagggctggggtttaatga

SEQ ID NO: 1041 - DNA, 808 bp, Artificial sequence
  Codon optimized synthetic BDL-4 coding sequence
ggatccccgggcggtcatgtctggtggaggaaacactatcactgctgttggtggaggtggagggggatgtggaggtggtggatcttctggtggtggaggatcatcagggggagggggaggtggaccttgtggagcttgcaagttccttcgtaggaagtgcgttccaggatgcattttcgctccatacttcgattctgagcagggatctgcttacttcgctgctgttcacaaggttttcggggcttctaacgtgtctaagctccttcttcatatcccagtgcacagacgttctgatgctgttgtgaccatttgttacgaggctcaggctagaattagagatccaatctatggatgcgtggcacatattttcgctcttcaacagcaggttgtgaaccttcaagctgaggtgtcataccttcaggctcatctcgcttctcttgagcttccacagccacaaactagaccacaacctatgccacagccacagccacttttctttactccaccaccaccacttgctatcactgatctcccagcttcagtttctccactcccatctacttacgatctcgcttctatcttcgatcagaccacctcttcatctgcttgggctactcagcagaggcgtttcattgatcctaggcatcagtacggggtgtcatcttcttcatcttcagtggctgttggacttggtggagagaactctcatgatcttcaggctctcgctcatgagttgcttcataggcaaggttctccaccacctgctgctaccgatcattctccatctaggaccatgtctaggtgatga

SEQ ID NO: 1042 - DNA, 1267 bp, Artificial sequence
  Codon optimized synthetic BDL-11 coding sequence
ggatccccgggaaatgatgactcacaacctcttcgctccactcgatctctcattctcttcatcatcatcttctagttcttctaccaagacctggcgttaccgtagaggttacatcgaaccatggtggcgtcctaacatcactaagggatacgtgttccttgaaagacctccaggaccagatcttcttccatggccacaacagtctccaccattctcagtgaacaaggaatctttcatcaccaataagttcaagacccaaatcaggctcttctactctctccaagagagtttcaagaaggcttctaaggaaaccagatggttcgttatcggggatgatgataccttgttcttcctcgataaccttgtgaaggctctcgataggtacaatcataagaagcactactacgttgggatgaatagtgagaacgtgtggtctaacgctatcttcgcattcgatatgggatacggtggtggaggatacgctctttcttacccaactgtggtgactcttctctctaacatggaagagtgcattaagcgttacctcggggtgtactctgatcttctcagtttccgttgccttgctgatcttgggatcgatctcactcttgagaaggggatgcatcagaacgatctccatggtgatatctctggactcctctctgctcatccacagtcaccactcatttctctccatcacttcgatgtgatcgatccaatcttccctggaatgaacagacagcagtctgtgaaccatttgatggaaactgctaagaccgatcagtctagggttctccagcagactatttgctaccagagggggtacaactggtctgtttctgtgagttggggatactctgtgcacatctaccagtcaatctacccaaggtctcatcttaagaggccacttgagactttcagaccttggaaggatgtgaggattccagcttacggtttcaacactaggcgtgtgactaacgatccttgtgagatgccaaggcagttcttcttcgattctgtggttgaggataagaaccagtctctcgtgaccaccatctataagatgaagatggaacgtagacttcctccatgccttctcaacggaaaccactcttctaggaacatcacccaagttagggtgatcgctaccaccatgcataagatggtggaaggtattgagtgctgcgatgttcagaacgtgaactctaccgagatccttgaggtgaagatcagggattgccacattgatgaggctctcgcttgatga

SEQ ID NO: 1043 - DNA, 1026 bp, Artificial sequence
  Codon optimized synthetic BDL-17 coding sequence
ggatccccgggaacaatggatattttcgtgtctttcgtggtgttcatcctctctgttctctcagtggagtctaccatccacatgaagtctatcaagctcgggaagaacgttatctatgattgcatggatatctacaagcagccttcactttctcatccactcctcaagcaccataacatcaggatgaagccaactggttgggatagtcagtctgagaacaagttcgctgagagaaggcacaacaacaagatcgagtgcccaaacggaactgttccaatccttagggctaaggaaaagcacgttatccagtaccaagagtaccctatcaacaacttcactgtgctcactgctaagtacccaggaactcacattgctggaatgaaggttgtggagaagcacaactaccgtggagttgaggctggacttaggacttacaacctcatcatcgataagaaccagtctacttctgctcaggcttacgttgctagagctttctctggggatgctaactctatccaagtgggatggatgattaacgagcagctcttcggagataagagaccatggtcatacggaacttggcttggaaagcacggaactggatgcttcaacgttaagtgcccaggattcgtgcaagttgctaagaacggaccaatctctgtgccactcaagttcgattacctcttgtggctcactatccaccaagagcttttcaaccttctcggtgatggggcagattttgttggtttcggggggatggtgtctggtgatcctagaacaccatctccaccaatgggaaacggtagactcccaaacaaggatgataggctctggtctggatacctcgatcacctcactattatccagccagattacgagcatgctgggttcaactacccaatgactgagccacttgtggattctaacgtgtgctacgatgtgaaccttgtgggatacgtggatcatcaagtgggaatcgctatgtcatacggtggaccaggtggtattaagtgcggggattgatga

SEQ ID NO: 1044 - DNA, 308 bp, Artificial sequence
  Codon optimized synthetic BDL-20b coding sequence
tggccatggctactaagtctgtgtcaaccttcgctattttcttcattctcgtgctcgctattttcgctgagactccagagattgaggcttacgataggaagtgtctcaaggaatatggtggagatgttgggttctcttactgcgctccaaggatcttcccaactttctgcgatcaaaattgtcgtaagaataagggtgctaagggtggtgtttgtcgttgggaggaaaacaatgctatcggagtgaagtgcctctgcaatttctgctctgaggaaccatcagatcagaccctctcaaggatctgatga

SEQ ID NO: 1045 - DNA, 703 bp, Artificial sequence
  Codon optimized synthetic BDL-24 coding sequence
aacaatggctcttctttgccatcatcagtctgaggttcaggctgctcaaaagccatctccagtggcttgctggtctagtatcaacaaggttcagggatgcgttgatgctgttaaggctgctacaaagggggattacaaggggctttctaaggattgctgccttgctatctacgggcttatcgatgattgcttcccaatcgtgttctctggaaagccagatatcgctgtgcttgtgaaggatgcttgcgcaatggttacattcaggctccagaaccttgagaggaagatcgatagtaccatggatatcatcgctgagttgaggcagagggaatctgtttaccgtactgctttcgtgcttactaaggctgagacagaggttaagcagttcgttatcaagactaagatggggactaagcagatcgtgaccgttatgttctttttcctctctgttatcatggctctcctctgccaccatcaaagtgaagctcaggctccaattcctacaccaggggattgcttctcttctatcaaaaaggtcaagggttgtgccgacgctgtcaaggcagcaactaagggtcatcttctcaggcttgttaaggactgttgtcacgttatcaacgatctcgctgatgattgctttcctatcatcttcccagggaagccatatattgctgctttggtgaagcacgcttgctcttgatga

SEQ ID NO: 1046 - DNA, 304 bp, Artificial sequence
  Codon optimized synthetic BDL-30 coding sequence
aacaatggcttcttacgagtctcagagggatgtggctgagttggctactcttgagcagaccaagaagaacgttgaggatgttgaggaagtgcttaagaagttggagcagacttacctcggaaaggaaaaggtgaccgatgatacccttctctctgatgaagagatggaaaagtttaaccagatgatgaattgcgtgaagctccttaacaactgcctcactaagatcggacagtctctcccacttaaggaaggggagagagagcttgttgaggttgaagtggatttcaagaacatcccatgatga

SEQ ID NO: 1047 - protein, 416 aa, Artificial sequence
  Translated product of cloned BDL11
MMTHNLFAPLDLSFSSSSSSSSSTKTWRYRRGYIEPWWRPNITKGYVFLERPPGPDLLPWPQQSPPFSVNKESFITNKFKTQIRLFYSLQESFKKASKETRWFVIGDDDTLFFLDNLVKALDRYNHKKHYYVGMNSENVWSNAIFAFDMGYGGGGYALSYPTVVTLLSNMEECIKRYLGVYSDLLSFRCLADLGIDLTLEKGMHQNDLHGDISGLLSAHPQSPLISLHHFDVIDPIFPGMNRQQSVNHLMETAKTDQSRVLQQTICYQRGYNWSVSVSWGYSVHIYQSIYPRSHLKRPLETFRPWKDVRIPAYGFNTRRVTNDPCEMPRQFFFDSVVEDKNQSLVTTIYKMKMERRLPPCLLNGNHSSRNITQVRVIATTMHKMVEGIECCDVQNVNSTEILEVKIRDCHIDEALA

SEQ ID NO: 1048 - protein, 60 aa, Artificial sequence
  Translated product of cloned BDL14
MDLQQSETDDKQPEQLVIYVCGDCGQENILKRGDVFQCRDCGFRILYKKRILDKKETRIV

SEQ ID NO: 1049 - DNA, 2001 bp, Artificial sequence
  GUS-Intron polynucleotide sequence
atgttacgtcctgtagaaaccccaacccgtgaaatcaaaaaactcgacggcctgtgggcattcagtctggatcgcgaaaactgtggaattggtcagcgttggtgggaaagcgcgttacaagaaagccgggcaattgctgtgccaggcagttttaacgatcagttcgccgatgcagatattcgtaattatgcgggcaacgtctggtatcagcgcgaagtctttataccgaaaggttgggcaggccagcgtatcgtgctgcgtttcgatgcggtcactcattacggcaaagtgtgggtcaataatcaggaagtgatggagcatcagggcggctatacgccatttgaagccgatgtcacgccgtatgttattgccgggaaaagtgtacgtaagtttctgcttctacctttgatatatatataataattatcattaattagtagtaatataatatttcaaatatttttttcaaaataaaagaatgtagtatatagcaattgcttttctgtagtttataagtgtgtatattttaatttataacttttctaatatatgaccaaaatttgttgatgtgcaggtatcaccgtttgtgtgaacaacgaactgaactggcagactatcccgccgggaatggtgattaccgacgaaaacggcaagaaaaagcagtcttacttccatgatttctttaactatgccggaatccatcgcagcgtaatgctctacaccacgccgaacacctgggtggacgatatcaccgtggtgacgcatgtcgcgcaagactgtaaccacgcgtctgttgactggcaggtggtggccaatggtgatgtcagcgttgaactgcgtgatgcggatcaacaggtggttgcaactggacaaggcactagcgggactttgcaagtggtgaatccgcacctctggcaaccgggtgaaggttatctctatgaactgtgcgtcacagccaaaagccagacagagtgtgatatctacccgcttcgcgtcggcatccggtcagtggcagtgaagggcgaacagttcctgattaaccacaaaccgttctactttactggctttggtcgtcatgaagatgcggacttgcgtggcaaaggattcgataacgtgctgatggtgcacgaccacgcattaatggactggattggggccaactcctaccgtacctcgcattacccttacgctgaagagatgctcgactgggcagatgaacatggcatcgtggtgattgatgaaactgctgctgtcggctttaacctctctttaggcattggtttcgaagcgggcaacaagccgaaagaactgtacagcgaagaggcagtcaacggggaaactcagcaagcgcacttacaggcgattaaagagctgatagcgcgtgacaaaaaccacccaagcgtggtgatgtggagtattgccaacgaaccggatacccgtccgcaaggtgcacgggaatatttcgcgccactggcggaagcaacgcgtaaactcgacccgacgcgtccgatcacctgcgtcaatgtaatgttctgcgacgctcacaccgataccatcagcgatctctttgatgtgctgtgcctgaaccgttattacggatggtatgtccaaagcggcgatttggaaacggcagagaaggtactggaaaaagaacttctggcctggcaggagaaactgcatcagccgattatcatcaccgaatacggcgtggatacgttagccgggctgcactcaatgtacaccgacatgtggagtgaagagtatcagtgtgcatggctggatatgtatcaccgcgtctttgatcgcgtcagcgccgtcgtcggtgaacaggtatggaatttcgccgattttgcgacctcgcaaggcatattgcgcgttggcggtaacaagaaagggatcttcactcgcgaccgcaaaccgaagtcggcggcttttctgctgcaaaaacgctggactggcatgaacttcggtgaaaaaccgcagcagggaggcaaacaatga

SEQ ID NO: 1050 - DNA, 1457 bp, Arabidopsis thaliana
  misc_feature: WRINKLED1 polynucleotide sequence
aaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaatttctatttcttccgcttcttcttcttttttttcttttgttgggttctgcttagggtttgtatttcagtttcagggcttgttcgttggttctgaataatcaatgtctttgcc

SEQ ID NO: 1051 - protein, 603 aa, Artificial sequence
  GUS-Intron polypeptide product
MLRPVETPTREIKKLDGLWAFSLDRENCGIGQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 1052 - protein, 430 aa, Arabidopsis thaliana
  misc_feature: WRINKLED1 polypeptide sequence
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQVYLGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

What is claimed is:

1. A method of increasing oil content, growth rate, biomass, yield and/or vigor of a plant, comprising introducing into the plant an exogenous polynucleotide encoding a polypeptide comprising the amino acid sequence set forth in SEQ ID NO: 199, thereby increasing the oil content, growth rate, biomass, yield and/or vigor of the plant.

2. A method of producing oil, comprising:

(a) providing the plant according to claim 1; and (b) extracting the oil from the plant;

thereby producing the oil.

3. The method of claim 1, wherein said polynucleotide comprises the nucleic acid sequence set forth in SEQ ID NO: 1039 or 34.

4. The method of claim 1, wherein said polynucleotide is set forth in SEQ ID NO: 1039 or 34.

5. The method of claim 1, wherein the oil comprises a seed oil.

6. The method of claim 1, wherein the oil comprises a vegetative portion oil.

7. The method of claim 1, wherein the plant is selected from the group consisting of maize, canola, soybean, cotton, rice and wheat.

8. The method of claim 1, wherein said exogenous polynucleotide is comprised in a nucleic acid construct under the regulation of a promoter selected from the group consisting of a constitutive promoter, a tissue-specific, a developmental and an embryo-specific promoter.

9. A transgenic plant having increased oil content, growth rate, biomass, yield and/or vigor when compared to a wild type plant of the same species which is grown under the same growth conditions, comprising a nucleic acid construct, which comprises an exogenous polynucleotide encoding the polypeptide set forth in SEQ ID NO:199, and a promoter for directing transcription of said polynucleotide in the plant.

10. The transgenic plant of claim 9, wherein said exogenous polynucleotide is set forth in SEQ ID NO:1039 or 34.

11. The method of claim 1, further comprising selecting a plant having the increased oil content, growth rate, biomass, yield and/or vigor as compared to a wild type plant of the same species which is grown under the same growth conditions.

* * * * *